US012503688B2

(12) United States Patent
Nazor et al.

(10) Patent No.: US 12,503,688 B2
(45) Date of Patent: Dec. 23, 2025

(54) ENGINEERED TRANSAMINASE POLYPEPTIDES

(71) Applicant: Codexis, Inc., Redwood City, CA (US)

(72) Inventors: Jovana Nazor, Milpitas, CA (US); Christopher Michael Micklitsch, Philadelphia, PA (US); Da Duan, Foster City, CA (US); Auric Anthony Sowell-Kantz, Fairfax, CA (US); Steven Miller, Rahway, NJ (US); Birgit Kosjek, Westfield, NJ (US); Iman Farasat, Rahway, NJ (US); Nicholas M. Marshall, Rahway, NJ (US)

(73) Assignee: Codexis, Inc., Redwood City, CA (US)

( * ) Notice: Subject to any disclaimer, the term of this patent is extended or adjusted under 35 U.S.C. 154(b) by 864 days.

(21) Appl. No.: 17/420,378

(22) PCT Filed: Jan. 13, 2020

(86) PCT No.: PCT/US2020/013288
§ 371 (c)(1),
(2) Date: Jul. 1, 2021

(87) PCT Pub. No.: WO2020/150125
PCT Pub. Date: Jul. 23, 2020

(65) Prior Publication Data
US 2022/0090033 A1  Mar. 24, 2022

Related U.S. Application Data

(60) Provisional application No. 62/792,518, filed on Jan. 15, 2019.

(51) Int. Cl.
*C12N 9/10* (2006.01)
*C12P 13/00* (2006.01)

(52) U.S. Cl.
CPC .......... *C12N 9/1096* (2013.01); *C12P 13/001* (2013.01)

(58) Field of Classification Search
None
See application file for complete search history.

(56) References Cited

U.S. PATENT DOCUMENTS

| | | | |
|---|---|---|---|
| 4,518,692 A | 5/1985 | Rozzell | |
| 4,600,692 A | 7/1986 | Wood et al. | |
| 4,826,766 A | 5/1989 | Rozzell | |
| 4,950,606 A | 8/1990 | Stirling et al. | |
| 5,169,780 A | 12/1992 | Stirling et al. | |
| 5,300,437 A | 4/1994 | Stirling et al. | |
| 5,316,943 A | 5/1994 | Kidman et al. | |
| 5,605,793 A | 2/1997 | Stemmer | |
| 5,811,238 A | 9/1998 | Stemmer et al. | |
| 5,830,721 A | 11/1998 | Stemmer et al. | |
| 5,834,252 A | 11/1998 | Stemmer et al. | |
| 5,837,458 A | 11/1998 | Minshull et al. | |
| 5,928,905 A | 7/1999 | Stemmer et al. | |
| 6,096,548 A | 8/2000 | Stemmer | |
| 6,117,679 A | 9/2000 | Stemmer | |
| 6,132,970 A | 10/2000 | Stemmer | |
| 6,165,793 A | 12/2000 | Stemmer | |
| 6,180,406 B1 | 1/2001 | Stemmer | |
| 6,197,558 B1 | 3/2001 | Fotheringham | |
| 6,251,674 B1 | 6/2001 | Tobin et al. | |
| 6,265,201 B1 | 7/2001 | Wackett et al. | |
| 6,277,638 B1 | 8/2001 | Stemmer | |
| 6,287,861 B1 | 9/2001 | Stemmer et al. | |
| 6,287,862 B1 | 9/2001 | delCardayre et al. | |
| 6,291,242 B1 | 9/2001 | Stemmer | |
| 6,297,053 B1 | 10/2001 | Stemmer | |
| 6,303,344 B1 | 10/2001 | Patten et al. | |
| 6,309,883 B1 | 10/2001 | Minshull et al. | |
| 6,319,713 B1 | 11/2001 | Patten et al. | |
| 6,319,714 B1 | 11/2001 | Crameri et al. | |
| 6,323,030 B1 | 11/2001 | Stemmer | |
| 6,326,204 B1 | 12/2001 | delCardayre et al. | |
| 6,335,160 B1 | 1/2002 | Patten et al. | |
| 6,335,198 B1 | 1/2002 | delCardayre et al. | |
| 6,337,186 B1 | 1/2002 | Krebber | |
| 6,344,356 B1 | 2/2002 | Stemmer | |
| 6,352,859 B1 | 3/2002 | delCardayre et al. | |
| 6,355,484 B1 | 3/2002 | Patten et al. | |

(Continued)

FOREIGN PATENT DOCUMENTS

| | | | |
|---|---|---|---|
| JP | 2012-519004 A | 8/2012 | |
| JP | 2016-509841 A | 4/2016 | |

(Continued)

OTHER PUBLICATIONS

Almahboub, S.A., et al. 2018 Scientific Reports 8:17397, 10 pages. (Year: 2018).*
Stenico, M., et al., "Codon usage in Caenorhabditis elegans: delineation of translational selection and mutational biases," Nucl. Acids Res. 22(13):2437-46 [1994].
Streitwieser, Jr., A., et al., "Polar Aprotic Solvents" in Introduction to Organic Chemistry, 2nd ed., Macmillan Publishing Col, Inc., New York, Sec 8.10, pp. 169-171 [1981].
Suggs, S.V., et al., "Use of synthetic oligodeoxyribonucleotides for the isolation of specific cloned DNA sequences," In Developmental Biology Using Purified Genes (Brown et al., eds.), pp. 683-693, Academic Press (1981).
Tiwari, S., et al., "Prediction of probable genes by Fourier analysis of genomic sequences," Comput. Appl. Biosci. 13(3):263-270 [1997].

(Continued)

*Primary Examiner* — Marsha Tsay
(74) *Attorney, Agent, or Firm* — FisherBroyles, LLP; Adam K. Whiting; Adelaide K. Leitzel

(57) ABSTRACT

The present invention provides engineered transaminase polypeptides and compositions thereof, as well as polynucleotides encoding the engineered transaminase polypeptides. Methods for producing transaminase enzymes are also provided. In some embodiments, the engineered transaminase polypeptides are optimized to provide improved enzyme properties under minimal aqueous conditions in wet organic solvents.

27 Claims, No Drawings

Specification includes a Sequence Listing.

(56) References Cited

U.S. PATENT DOCUMENTS

| | | |
|---|---|---|
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 A2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,169,592 B2 | 1/2007 | Yamada et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selifonov et al. |
| 7,430,477 B2 | 9/2008 | Selifonov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selifonov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,293,507 B2 | 10/2012 | Savile et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 9,593,326 B2 | 3/2017 | Clark et al. |
| 2006/0195947 A1 | 8/2006 | Davis et al. |
| 2008/0220990 A1 | 9/2008 | Fox |
| 2009/0312196 A1 | 12/2009 | Colbeck et al. |
| 2010/0285541 A1 | 11/2010 | Savile et al. |
| 2013/0164794 A1 | 6/2013 | Limanto et al. |
| 2014/0356944 A1 | 12/2014 | Cabirol et al. |
| 2015/0079640 A1 | 3/2015 | Hughes et al. |
| 2017/0088868 A1 | 3/2017 | Savile et al. |

FOREIGN PATENT DOCUMENTS

| | | |
|---|---|---|
| WO | 95/22625 A1 | 8/1995 |
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 00/42651 A1 | 7/2000 |
| WO | 01/75767 A2 | 10/2001 |
| WO | 2005/005633 A2 | 1/2005 |
| WO | 2008/127646 A2 | 10/2008 |
| WO | 2009/008908 A2 | 1/2009 |
| WO | 2009/152336 A1 | 12/2009 |
| WO | 2010/099501 A2 | 9/2010 |
| WO | 2011/005477 A1 | 1/2011 |
| WO | 2011/017551 A1 | 2/2011 |
| WO | 2011/159910 A2 | 12/2011 |
| WO | 2012/024104 A2 | 2/2012 |
| WO | 2012/177527 A1 | 12/2012 |
| WO | 2013/036861 A1 | 3/2013 |
| WO | 2014/133960 A1 | 9/2014 |
| WO | 2020/150125 A1 | 7/2020 |

OTHER PUBLICATIONS

Truppo, M.D., et al., "Development of an Improved Immobilized CAL-B for the Enzymatic Resolution of a Key Intermediate to Odanacatib," Organic Process Research & Development, 15:1033-1035 (2011).

Uberbacher, E.C., et al., "Discovering and Understanding Genes in Human DNA Sequence Using Grail," Methods Enzymol., 266:259-281 [1996].

Villa-Komaroff, L., et al., "A bacterial clone synthesizing proinsulin," Proc. Natl Acad. Sci. USA, 75:3727-3731 (1978).

Wada, K., et al., "Codon usage tabulated from the GenBank genetic sequence data," Nucl. Acids Res., 20:2111-2118 [1992].

Wells, J.A., et al., "Cassette mutagenesis: an efficient method for generation of multiple mutations at defined sites," Gene, 34:315-323 (1985).

Wetmur, J. G., "DNA Probes: Applications of the Principles of Nucleic Acid Hybridization," Crit Rev Biochem Mol Biol, 26(3/4):227-259 (1991).

(56) References Cited

OTHER PUBLICATIONS

Wright, F., "The 'effective number of codons' used in a gene," Gene 87:23-29 [1990].
Yi, S., et al., "Covalent immobilization of omega-transaminase from Vibrio fluvialis JS17 on chitosan beads," Process Biochemistry 42(5): 895-898 (2007).
Yonaha, K., et al., "Distribution of ω-Amino Acid : Pyruvate Transaminase and Aminobutyrate : α-Ketoglutarate Transaminase in Microorganisms," Agric. Biol. Chem., 47 (10):2257-2265 [1983].
Yun, H., et al., "ω-Amino Acid:Pyruvate Transaminase from Alcaligenes denitrificans Y2k-2: a New Catalyst for Kinetic Resolution of β-Amino Acids and Amines," Appl. Environ. Microbiol., 70:2529-2534 [2004].
Zhang, H., et al., "PolyA_DB: a database for mammalian mRNA polyadenylation," Nucleic Acids Res., 33:D116-D120 [2005].
Zhang, J-H., et al., "Directed evolution of a fucosidase from a galactosidase by DNA shuffling and screening," Proc. Nat. Acad. Sci., U.S.A., 94:4504-4509 (1997).
GenBank Accession No. ABA47738.1 dated Jan. 31, 2014.
GenBank Accession No. AEA39183.1 dated Apr. 4, 2011.
GenBank Accession No. AM902716.1 dated Feb. 27, 2015.
GenBank Accession No. BAK39753.1 dated Feb. 16, 2012.
NCBI Accession No. YP_002257813 dated Aug. 27, 2013.
Organic Chemistry, 5th Ed., John McMurry, Brooks/Cole Publishing (2001), pp. 398 and 408.
Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Baldino, Jr., F., et al., "High-Resolution in Situ Hybridization Histochemistry," Methods Enzymology, 168:761-777 (1989).
Batzer, M.A., "Erratum: Structure and variability of recently inserted Alu family members", Nucleic Acids Res 19:698-699 [1991].
Beaucage, S.L., et al., "Deoxynucleoside phosphoamidites—a new class of key intermediates for deoxypolynucleotide synthesis," Tetrahedron Letters, 22(20):1859-62 (1981).
Bolton, E.T., et al., "A General Method for the Iisolation of RNA Complementary to DNA," Proc. Natl. Acad. Sci. USA 48:1390 ( 1962).
Botstein, D., et al., "Strategies and applications of in vitro mutagenesis," Science, 229(4719):1193-1201 [1985].
Breslauer, K.J., et al., "Predicting DNA duplex stability from the base sequence," Proc. Natl. Acad. Sci. USA, 33:3746-3750 (1986).
Carey, F.A., "Sulfonate Esters as Substrates in Nucleophilic Substitution Reactions," in Organic Chemistry, 2nd ed., McGraw-Hill, Inc., New York, Chapter 8.15, pp. 328-331 [1992].
Carter, P., "Site-directed mutagenesis," Biochem. J., 237:1-7 (1986).
Christians, F.C., et al., "Directed evolution of thymidine kinase for AZT phosphorylation using DNA family shuffling," Nat. Biotechnol., 17:259-264 (1999).
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling," Nat. Biotechnol., 14(3):315-319 (1996).
Crameri, A., et al., "Molecular evolution of an arsenate detoxification pathway by DNA shuffling," Nat. Biotechnol., 15(5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80: 21-25 (1983).
Ehrlich, S.D., "DNA cloning in Bacillus subtilis," Proc Natl Acad Sci. USA, 75:1433 (1978).
Eisenberg, D., et al., "Analysis of Membrane and Surface Protein Sequences with the Hydrophobic Moment Plot," J. Mol. Biol., 179:125-142 [1984].
Fasman, G.D., "Section 1. Amino Acids and Proteins," in Practical Handbook of Biochemistry and Molecular Biology, CRC Press, Boca Raton, FL, at pp. 3-70 [1989].
Freier, S.M., et al., "Improved free-energy parameters for predictions of RNA duplex stability," Proc. Natl. Acad. Sci USA, 83:9373-9377 (1986).
Guo, Z., et al., "3'-End-Forming Signals of Yeast mRNA," Mol. Cell. Biol., 15(11):5983-5990 [1995].
Hienaut and Danchin in Neidhardt et al. [eds.], *Escherichia coli* and *Salmonella*, "Analysis and predictions from *Escherichia coli* Sequences, or *E. coli* in silico," ASM Press, Washington D.C., [1987], pp. 2047-2066.
Henikoff, S., et al., "Amino acid substitution matrices from protein blocks," Proc. Natl. Acad. Sci. USA, 89:10915-10919 [1992].
Hwang, B.-Y., et al., "High-throughput screening method for the identification of active and enantioselective ω-transaminases", Enzyme and Microbial Technology, 34:429-436 [2004].
Iwasaki, A., et al., "Microbial synthesis of (R)- and (S)-3,4-dimethoxyamphetamines through stereoselective transamination," Biotech. Lett., 25:1843-1846 [2003].
Iwasaki, A., et al., "Microbial synthesis of chiral amines by (R)-specific transamination with *Arthrobacter* sp. KNK168," Appl. Microbiol. Biotechnol., 69: 499-505 (2006).
Kierzek, R., et al., "Polymer-Supported RNA Synthesis and Its Application to Test the Nearest-Neighbor Model for Duplex Stability," Biochemistry, 25:7840-7846 (1986).
Koszelewski, D., et al., "Immobilization of omega-transaminases by encapsulation in a sol-gel/celite matrix," Journal of Molecular Catalysis B: Enzymatic, 63: 39-44 (2010).
Kramer, B., et al., "Different base/base mismatches are corrected with different efficiencies by the methyl-directed DNA mismatch-repair system of *E. coli*," Cell, 38(3):879-887 [1984].
Lathe, R., et al., "Plasmid and bacteriophage vectors for excision of intact inserts," Gene, 57:193-201 (1987).
Ling, M., et al., "Approaches to DNA Mutagenesis:An Overview," Anal. Biochem., 254:157-78 (1997).
Martin, A.R., et al., "Characterization of free and immobilized (S)-aminotransferase for acetophenone production," Applied Microbiology and Biotechnology, 76(4): 843-851 (2007).
Mateo, C., et al., "Epoxy sepabeads: a novel epoxy support for stabilization of industrial enzymes via very intense multipoint covalent attachment," Biotechnology Progress 18(3):629-34 (2002).
Matthes, H.W.D., et al., "Simultaneous rapid chemical synthesis of over one hundred oligonucleotides on a microscale," EMBO J., 3(4):801-05 (1984).
Mcinerney, J.O., "GCUA: general codon usage analysis," Bioinformatics, 14(4):372-73 [1998].
Minshull, J., et al., "Protein evolution by molecular breeding," Curr. Op. Chem. Biol., 3(3):284-290 (1999).
Mutti, F.G., et al., "Asymmetric Bio-amination of Ketones in Organic Solvents," Adv. Synth. Catal., 354: 3409-3413 [2012].
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
Pearson, W.R., "Improved tools for biological sequence comparison," Proc. Nat'l. Acad. Sci. USA, 85:2444-2448 (1988).
Romanos, M.A., et al., "Foreign gene expression in yeast: a review," Yeast 8:423-488 [1992].
Rychlik, W., et al., "Optimization of the annealing temperature for DNA amplification in vitro," Nucleic Acids Res, 18(21):6409-6412 (1990).
Savile, C.K., et al., "Biocatalytic asymmetric synthesis of chiral amines from ketones applied to sitagliptin manufacture," Science 329(5989):305-9 (2010).
Shin, J.S., et al., "Comparison of the omega-transaminases from different microorganisms and application to production of chiral amines," Biosci. Biotechnol. Biochem. 65:1782-1788 (2001).
Shin, J.S., et al., "Purification, characterization, and molecular cloning of a novel amine:pyruvate transaminase from Vibrio fluvialis JS17," Appl. Microbiol. Biotechnol., 61(5-6):463-471 [2003].

(56) References Cited

OTHER PUBLICATIONS

Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).

\* cited by examiner

ENGINEERED TRANSAMINASE POLYPEPTIDES

The present application is a national stage application filed under 35 USC § 371 and claims priority to PCT International Application No. PCT/US2020/013288, filed Jan. 13, 2020, which claims priority to U.S. Pat. Appln. Ser. No. 62/792,518, filed on Jan. 15, 2019, both of which are hereby incorporated by reference in their entirety for all purposes.

FIELD OF THE INVENTION

The disclosure relates to engineered transaminase polypeptides useful under industrial process conditions for the production of pharmaceutical and fine chemical amine compounds.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-183WO1_ST25.txt", a creation date of Jan. 10, 2020 and a size of 1.72 megabytes. The Sequence Listing filed via EFS-Web is part of the specification and incorporated in its entirety by reference herein.

BACKGROUND

Transaminases (E.C. 2.6.1) catalyze the transfer of an amino group, a pair of electrons, and a proton from an amino donor compound to the keto group of an amino acceptor compound. Transaminase reactions can result in the formation of a chiral amine product compound. As shown in Scheme 1, an amino acceptor compound (B) (which is the keto substrate precursor of a desired chiral amine product (D)) is reacted with an amino donor compound (A) in the presence of a transaminase. The transaminase catalyzes the transfer of the primary amine group of the amino donor compound (A) to the keto group of the amino acceptor compound (B). The transaminase reaction results in a chiral amine product compound (D) (assuming $R^1$ is not the same as $R^2$) and a new amino acceptor byproduct (or "carbonyl byproduct") compound (C) which has a keto group.

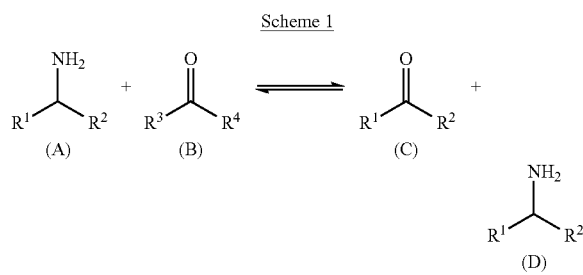

Scheme 1

Chiral amine compounds are frequently used in the pharmaceutical, agrochemical, and chemical industries as intermediates or synthons for the preparation of wide range of commercially desired compounds, such as cephalosporine or pyrrolidine derivatives. Typically these industrial applications of chiral amine compounds involve using only one particular stereomeric form of the molecule, e.g., only the (R) or the (S) enantiomer is physiologically active. Transaminases are highly stereoselective and have many potential industrial uses for the synthesis of optically pure chiral amine compounds.

Examples of the uses of transaminases to make chiral amine compounds include: the enantiomeric enrichment of amino acids (See e.g., Shin et al., 2001, *Biosci. Biotechnol. Biochem.* 65:1782-1788; Iwasaki et al., 2003, *Biotech. Lett.* 25:1843-1846; Iwasaki et al., 2004, *Appl. Microb. Biotech.* 69:499-505, Yun et al., 2004, *Appl. Environ. Microbiol.* 70:2529-2534; and Hwang et al., 2004, *Enzyme Microbiol. Technol.* 34:429-426); the preparation of intermediates and precursors of pregabalin (e.g., WO 2008/127646); the enzymatic transamination of cyclopamine analogs (e.g., WO 2011/017551); the stereospecific synthesis and enantiomeric enrichment of β-amino acids (e.g., WO 2005/005633); the enantiomeric enrichment of amines (e.g., U.S. Pat. Nos. 4,950,606; 5,300,437; and 5,169,780); the production of amino acids and derivatives (e.g., U.S. Pat. Nos. 5,316,943; 4,518,692; 4,826,766; 6,197,558; and 4,600,692); and in the production of the pharmaceutical compounds, sitagliptin, rivastigmine, and vernakalant (See e.g., U.S. Pat. No. 8,293,507 B2, issued Oct. 23, 2012; Savile, et al., 2010, "Biocatalytic asymmetric synthesis of chiral amines from ketones applied to sitagliptin manufacture," *Science* 329(5989): 305-9; WO2011/159910, published Dec. 22, 2011; and WO2012/024104, published Feb. 23, 2012).

Wild-type transaminases having the ability to catalyze a reaction of Scheme 1 have been isolated from various microorganisms, including, but not limited to, *Alcaligenes denitrificans, Bordetella bronchiseptica, Bordetella parapertussis, Brucella melitensis, Burkholderia malle, Burkholderia pseudomallei, Chromobacterium violaceum, Oceanicola granulosus* HTCC2516, *Oceanobacter* sp. RED65, *Oceanospirillum* sp. MED92, *Pseudomonas putida, Ralstonia solanacearum, Rhizobium meliloti, Rhizobium* sp. (strain NGR234), *Bacillus thuringensis, Klebsiella pneumonia, Vibrio fluvialis* (See e.g., Shin et al., 2001, *Biosci. Biotechnol, Biochem.* 65:1782-1788), and *Arthrobacter* sp. KNK168 (See e.g., Iwasaki et al., *Appl. Microbiol. Biotechnol.*, 2006, 69: 499-505, U.S. Pat. No. 7,169,592). Several of these wild-type transaminase genes and encoded polypeptides have been sequenced, including e.g., *Ralstonia solanacearum* (Genbank Acc. No. YP_002257813.1, GI:207739420), *Burkholderia pseudomallei* 1710b (Genbank Acc. No. ABA47738.1, GI:76578263), *Bordetella petrii* (Genbank Acc. No. AM902716.1, GI:163258032), *Vibrio fluvialis* JS17 (Genbank Acc. No. AEA39183.1, GI: 327207066), and *Arthrobacter* sp. KNK168 (GenBank Acc. No. BAK39753.1, GI:336088341). At least two wild-type transaminases of classes EC 2.6.1.18 and EC 2.6.1-19, have been crystallized and structurally characterized (See e.g., Yonaha et al., 1983, Agric. Biol. Chem. 47 (10):2257-2265).

Transaminases are known that have (R)-selective or (S)-selective stereoselectively. For example, the wild-type transaminase from *Arthrobacter* sp. KNK168 is considered (R)-selective and produces primarily (R)-amine compounds from certain substrates (See e.g., Iwasaki et al., *Appl. Microbiol. Biotechnol.*, 2006, 69: 499-505, U.S. Pat. No. 7,169,592), whereas the wild-type transaminase from *Vibrio fluvialis* JS17 is considered (S)-selective and produces primarily (S)-amine compounds from certain substrates (See e.g., Shin et al., "Purification, characterization, and molecular cloning of a novel amine:pyruvate transaminase from *Vibrio fluvialis* JS17,"*Appl. Microbiol. Biotechnol.* 61 (5-6), 463-471 (2003)).

Non-naturally occurring transaminases having (R)-selectivity, increased solvent and thermal stability, and other improved properties for the conversion of a wide range of amino acceptor substrates, have been generated by mutagenesis and/or directed evolution of wild-type and other engineered transaminase backbone sequences (See e.g., U.S. Pat. No. 8,293,507 B2, issued Oct. 23, 2012; WO2011/005477A1, published Jan. 13, 2011; WO2012/024104, published Feb. 23, 2012; and Savile, et al., 2010, "Biocatalytic asymmetric synthesis of chiral amines from ketones applied to sitagliptin manufacture," Science 329(5989): 305-9).

Wild-type transaminases generally have properties that are undesirable for commercial application in the preparation of chiral amine compounds, such as instability to industrially useful process conditions (e.g., solvent, temperature), poor recognition of, and stereoselectivity for, commercially useful amino acceptor and/or amino donor substrates, and low product yields due to unfavorable reaction equilibrium.

In particular, transaminase reactions are generally conducted under aqueous conditions at high pH. Typical aqueous reaction conditions often result in low substrate solubility, necessitating an organic co-solvent. Reaction under aqueous conditions is often complicated by product and substrate instability. Additional process steps are often required, such as basification of the reaction mixture and extraction of the amine product with an organic solvent.

SUMMARY OF THE INVENTION

The present invention provides engineered transaminase polypeptides and compositions thereof, as well as polynucleotides encoding the engineered transaminase polypeptides. Methods for producing transaminase enzymes are also provided. In some embodiments, the engineered transaminase polypeptides are optimized to provide improved enzyme properties under minimal aqueous conditions in wet organic solvents. The transaminase polypeptides of the present disclosure have been engineered to have one or more residue differences as compared to a previously engineered transaminase polypeptide (of amino acid sequence SEQ ID NO:2) and associated improved enzyme properties relative to previously engineered transaminase polypeptides (See e.g., U.S. Pat. No. 8,293,507 B2, issued Oct. 23, 2012; PCT Publication WO2011005477A1, published Jan. 13, 2011, and PCT publication WO2012024104, published Feb. 23, 2012). The amino residue differences are located at residue positions that result in improvement of various enzyme properties, including among others, activity, stereoselectivity, stability, expression, product tolerance, and thermoactivity in wet organic solvents.

In particular, the engineered transaminase polypeptides of the present disclosure have been engineered for efficient conversion of the substrate, methyl 4-methyl-3-oxo-pentanoate (referred to herein as "compound (2)"), to its corresponding chiral amine product compound, methyl (S)-3-amino-4-methyl-pentanoate (referred to herein as "compound (1)") in minimal aqueous conditions in wet organic solvents, as shown in Scheme 2.

Scheme 2

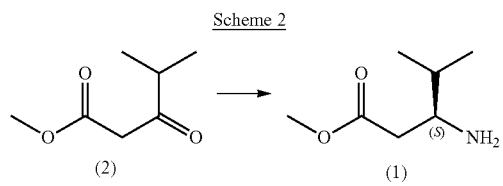

The evolved structural features of the engineered transaminase polypeptides of the present disclosure, however, also allow for the biocatalytic conversion of a range of keto ester substrate compounds of Formula (II) (including compounds other than compound (2)) to their corresponding chiral amine product compounds of Formula (I) (including compounds other than compound (1)) as shown in Scheme 3, Scheme 3

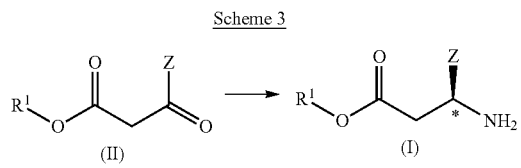

wherein
Z is a linear $C_{1-6}$ alkyl or a branched $C_{1-6}$ alkyl, optionally substituted with one or more hydroxy, cyano, or nitro groups; and
$R^1$ is $C_{1-6}$ alkyl, aryl-$C_{1-2}$ alkyl, heteroaryl-$C_{1-2}$ alkyl, or a 5- to 6-membered heterocyclic ring system optionally containing an additional heteroatom selected from O, S, and N, the heterocyclic ring being unsubstituted or substituted with one to three substituents independently selected from oxo, hydroxy, halogen, $C_{1-4}$ alkoxy, and $C_{1-4}$ alkyl.

In some embodiments, the engineered transaminase polypeptide are capable of biocatalytic conversion of compounds of Formula (II) to compounds of Formula (I) having the indicated stereochemical configuration at the stereogenic center marked with an *; in an enantiomeric excess of at least 70% over the opposite enantiomer.

The present invention provides engineered polypeptides having transaminase activity comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO:2, 6, 332, 518 and/or 656, or a functional fragment thereof, wherein said engineered polypeptide comprises a polypeptide comprising at least one substitution or substitution set in said polypeptide sequence, and wherein the amino acid positions of said polypeptide sequence are numbered with reference to SEQ ID NO:2, 6, 332, 518 and/or 656. In some embodiments, the reference sequence is SEQ ID NO:2. In some embodiments, the reference sequence is SEQ ID NO:6. In some embodiments, the reference sequence is SEQ ID NO:332. In some embodiments, the reference sequence is SEQ ID NO:518. In some embodiments, the reference sequence is SEQ ID NO:656.

In some embodiments, the polypeptide sequence has at least 85%, 86%, 87%, 88%, 89%, 90%, 91%, 92%, 93%, 94%, 95%, 96%, 97%, 98%, 99%, or more sequence identity to SEQ ID NO:2, and wherein the engineered polypeptide comprises at least one substitution or substitution set at one or more positions in said polypeptide sequence selected from 284 and 284/155, wherein the amino acid positions of said polypeptide sequence are numbered with reference to SEQ ID NO:2. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:2, and wherein the polypeptide sequence of the engineered polypeptide comprises at least one substitution or substitution set at one or more positions in said polypeptide sequence selected from 284A and 284A/155W, wherein the amino acid positions of said polypeptide sequence are numbered with reference to SEQ ID NO:2. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:2, and wherein the polypeptide sequence of the engineered polypeptide comprises at least one substitution or substitution set at one or more positions in said polypeptide sequence selected from G284A and G284A/L155W, wherein the amino acid positions of said polypeptide sequence are numbered with reference to SEQ ID NO:2. In some embodiments, the engineered polypeptide comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:2. In some embodiments, the engineered polypeptide comprises a polypeptide sequence having at least 90%, 91%, 92%, 93%, 94%, 95%, 96%, 97%, 98%, 99%, or more sequence identity to SEQ ID NO:2. In some embodiments, the engineered polypeptide comprises a polypeptide sequence having at least 95%, 96%, 97%, 98%, 99%, or more sequence identity to SEQ ID NO:2.

In some embodiments, the present invention provides engineered polypeptides having at least 85%, 86%, 87%, 88%, 89%, 90%, 91%, 92%, 93%, 94%, 95%, 96%, 97%, 98%, 99%, or more sequence identity to SEQ ID NO:6, wherein the engineered polypeptide comprises at least one substitution or substitution set at one or more positions in said polypeptide sequence selected from 5/35, 9, 9/20/23/24/134/244, 9/20/23/101/244, 9/20/24/101/244/249, 9/23/24, 9/23/24/29/244, 9/23/24/101/262, 9/23/24/244/262, 9/23/29, 9/24/244, 9/24/244/262, 9/24/249, 9/45/89/93, 9/79/101/244, 9/82/89, 9/89/246, 9/89/271, 9/93/142/246, 9/101/244, 9/110/302, 9/244/249, 9/244/262/264, 9/246, 9/262, 15, 15/16/18/20/89/93/160, 15/24/26/89/93/160, 15/35/273, 15/218/273, 15/249/273, 16, 17/25, 17/25/41, 17/25/160, 17/160, 18, 18/26/246/273, 18/146, 18/146/168, 18/146/262, 18/168, 18/168/244, 18/168/262/324, 18/244, 18/244/246, 18/244/246/284, 18/244/248, 18/244/262/273, 18/244/273, 18/262, 18/273, 20, 20/23/24/55/134/244/262, 20/23/134/244, 20/24/89/197, 20/33/160, 20/324, 22, 22/102, 22/160, 23, 23/25/55/321, 23/25/102/142, 23/102, 23/321, 24, 25, 25/33, 25/104, 25/160, 25/321, 26, 26/273, 29, 29/89, 32, 33, 35, 35/215/218/249, 35/218/249/273, 35/221, 40, 40/168/208/244, 40/244/248, 41, 41/102, 42, 45, 46, 50, 55, 56, 71/102, 74, 79, 82, 82/244, 89, 89/93/156/324, 89/93/321/324, 90, 93, 93/324, 95, 98, 101, 101/160/244/249, 102, 104, 106, 111, 114, 117, 119, 134, 134/244, 134/262, 139, 140/266, 142, 142/321, 145, 146, 146/244, 146/273, 156, 160, 160/215/216/218, 160/273, 168, 168/244/273, 179, 186, 186/200, 197, 203, 207, 208, 208/246, 215, 215/216/249, 216, 216/273, 218, 218/249, 218/313, 234, 236, 244, 244/248, 244/248/284, 244/273, 246, 246/248/273, 248, 249, 249/273, 256, 262, 264, 265, 266, 271, 273, 284, 301, 316, 320, 321, 324, and 329, wherein the amino acid positions of said polypeptide sequence are numbered with reference to SEQ ID NO:6. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:6, and wherein the polypeptide sequence of the engineered polypeptide comprises at least one substitution or substitution set at one or more positions in said polypeptide sequence selected from 5T/35Y, 9H, 9H/45L/89Q/93H, 9H/82S/89Q, 9H/89Q/246L, 9H/89Q/271C, 9H/93H/142M/246L, 9H/110V/302F, 9H/246L, 9T, 9T/20T/23Q/24F/134S/244G, 9T/20T/23Q/ 101S/244L, 9T/20T/24F/101S/244G/249G, 9T/23Q/24F, 9T/23Q/24F/29M/244G, 9T/23Q/24F/101S/262V, 9T/23Q/24F/244L/262T, 9T/23Q/29M, 9T/24F/244G, 9T/24F/244G/262T, 9T/24F/244G, 9T/79G/101S/244G, 9T/101S/244G, 9T/244G/249G, 9T/244G/262T/264N, 9T/262T, 15I, 15I/16I/18R/20H/89M/93M/160L, 15I/24P/26P/89M/93M/160L, 15T, 15T/35G/273K, 15T/218R/273K, 15T/249M/273K, 16I, 17I/25R, 17I/25R/41F, 17I/25R/160V, 17I/160V, 18G, 18G/26H/246V/273T, 18G/146L, 18G/146L/262V, 18G/168P, 18G/244G, 18G/244G/248M, 18G/244L/273V, 18G/273T, 18G/273V, 18K, 18K/146L, 18K/146L/168P, 18K/168P, 18K/168P/244L, 18K/168P/262V/324W, 18K/244G/246V, 18K/244G/246V/284G, 18K/244L, 18K/244L/246V, 18K/244T/262V/273T, 18K/262V, 18K/273T, 18R, 20H, 20H/24P/89M/197T, 20H/33L/160L, 20H/324C, 20T, 20T/23Q/24F/55F/134G/244G/262T, 20T/23Q/134S/244G, 22H, 22L, 22L/102L, 22L/160V, 22W, 23H, 23H/25R/55L/321Y, 23H/25R/102L/142L, 23H/102L, 23H/321Y, 23Q, 24D, 24F, 24P, 25R, 25R/33M, 25R/104V, 25R/160V, 25R/321Y, 26H/273K, 26P, 29K, 29K/89Q, 29M, 32L, 32S, 33L, 33M, 33S, 35G, 35G/215L/218R/249T, 35G/218R/249T/273K, 35G/221D, 40M, 40M/168P/208L/244G, 40M/244G/248M, 41F/102L, 41K, 41Y, 42T, 45L, 46C, 50T, 55F, 55G, 55K, 55S, 56R, 71Y/102P, 74A, 79G, 79H, 82P, 82S/244D, 82T, 89L, 89M, 89M/93M/156L/324C, 89M/93M/321V/324C, 89Q, 89W, 90A, 90C, 90S, 90T, 93H, 93M, 93M/324C, 93P, 95P, 95T, 98M, 101L, 101L/160Y/244E/249M, 101S, 102L, 104I, 104S, 106S, 111L, 111T, 114T, 117D, 119A, 134G, 134G/244L, 134G/262V, 134S, 139A, 140N/266N, 142L/321Y, 142T, 145N, 146A, 146A/244D, 146H, 146I, 146L, 146L/244L, 146L/273V, 156E, 156L, 156T, 160A, 160L, 160V, 160Y, 160Y/215L/216G/218R, 160Y/273K, 168P, 168P/244L/273T, 179R, 186R, 186R/200R, 197L, 197T, 203P, 207Y, 208K, 208L, 208L/246V, 208P, 208R, 215L, 215L/216G/249M, 216G, 216P, 216P/273V, 216S, 218N/313H, 218R, 218R/249M, 218S, 234H, 236T, 244E, 244G, 244G/248M, 244G/248M/284G, 244L, 244L/273C, 244L/273V, 244T, 246A, 246L, 246V, 246V/248M/273V, 248M, 248V, 249G, 249M, 249M/273K, 249T, 256C, 262L, 262P, 262T, 262V, 264A, 264E, 264G, 264N, 264P, 264R, 264W, 265R, 266G, 266S, 271C, 273L, 273M, 273T, 273V, 284G, 301E, 301M, 316R, 320R, 320W, 321L, 321V, 321Y, 324C, 324V, 324W, and 329R, wherein the amino acid positions of said polypeptide sequence are numbered with reference to SEQ ID NO:6. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:6, and wherein the polypeptide sequence of the engineered polypeptide comprises at least one substitution or substitution set at one or more positions in said polypeptide sequence selected from A5T/A35Y, E9H, E9H/F45L/S89Q/S93H, E9H/D82S/S89Q, E9H/S89Q/I246L, E9H/S89Q/E271C, E9H/S93H/K142M/I246L, E9H/L110V/V302F, E9H/I246L, E9T, E9T/Y20T/Y23Q/S24F/T134S/P244G, E9T/Y20T/Y23Q/T101S/P244L, E9T/Y20T/S24F/T101S/P244G/K249G, E9T/Y23Q/S24F, E9T/Y23Q/S24F/D29M/P244G, E9T/Y23Q/S24F/T101S/A262V, E9T/Y23Q/S24F/P244L/A262T, E9T/Y23Q/D29M, E9T/S24F/P244G, E9T/S24F/P244G/A262T, E9T/S24F/K249G, E9T/R79G/T101S/P244G, E9T/T101S/P244G, E9T/P244G/K249G, E9T/P244G/A262T/L264N, E9T/A262T, D15I, D15I/T16I/L18R/Y20H/S89M/S93M/F160L, D15I/S24P/Y26P/S89M/S93M/F160L, D15T, D15T/A35G/Y273K, D15T/L218R/Y273K, D15T/K249M/Y273K, T16I, G17I/D25R, G17I/D25R/I41F, G17I/D25R/F160V, G17I/F160V, L18G, L18G/Y26H/I246V/Y273T, L18G/Q146L, L18G/Q146L/A262V, L18G/H168P, L18G/
P244G, L18G/P244G/R248M, L18G/P244L/Y273V, L18G/
Y273T, L18G/Y273V, L18K, L18K/Q146L, L18K/Q146L/
H168P, L18K/H168P, L18K/H168P/P244L, L18K/H168P/
A262V/L324W, L18K/P244G/I246V, L18K/P244G/I246V/
A284G, L18K/P244L, L18K/P244L/I246V, L18K/P244T/
A262V/Y273T, L18K/A262V, L18K/Y273T, L18R, Y20H,
Y20H/S24P/S89M/R197T, Y20H/P33L/F160L, Y20H/
L324C, Y20T, Y20T/Y23Q/S24F/I55F/T134G/P244G/
A262T, Y20T/Y23Q/T134S/P244G, T22H, T22L, T22L/
Q102L, T22L/F160V, T22W, Y23H, Y23H/D25R/I55L/
P321Y, Y23H/D25R/Q102L/K142L, Y23H/Q102L, Y23H/
P321Y, Y23Q, S24D, S24F, S24P, D25R, D25R/P33M,
D25R/E104V, D25R/F160V, D25R/P321Y, Y26H/Y273K,
Y26P, D29K, D29K/S89Q, D29M, N32L, N32S, P33L,
P33M, P33S, A35G, A35G/G215L/L218R/K249T, A35G/
L218R/K249T/Y273K, A35G/E221D, W40M, W40M/
H168P/E208L/P244G, W40M/P244G/R248M, I41F/
Q102L, I41K, I41Y, G42T, F45L, V46C, E50T, I55F, I55G,
I55K, I55S, F56R, H71Y/Q102P, N74A, R79G, R79H,
D82P, D82S/P244D, D82T, S89L, S89M, S89M/S93M/
Q156L/L324C, S89M/S93M/P321V/L324C, S89Q, S89W,
N90A, N90C, N90S, N90T, S93H, S93M, S93M/L324C,
S93P, R95P, R95T, P98M, T101L, T101L/F160Y/P244F/
K249M, T101S, Q102L, E104I, E104S, K106S, E111L,
E111T, A114T, E117D, R119A, T134G, T134G/P244L,
T134G/A262V, T134S, D139A, I140N/D266N, K142L/
P321Y, K142T, P145N, Q146A, Q146A/P244D, Q146H,
Q146I, Q146L, Q146L/P244L, Q146L/Y273V, Q156E,
Q156L, Q156T, F160A, F160L, F160V, F160Y, F160Y/
G215L/D216G/L218R, F160Y/Y273K, H168P, H168P/
P244L/Y273T, P179R, Q186R, Q186R/Q200R, R197L,
R197T, H203P, F207Y, E208K, E208L, E208L/I246V,
E208P, E208R, G215L, G215L/D216G/K249M, D216G,
D216P, D216P/Y273V, D216S, L218N/R313H, L218R,
L218R/K249M, L218S, V234H, R236T, P244E, P244G,
P244G/R248M, P244G/R248M/A284G, P244L, P244L/
Y273C, P244L/Y273V, P244T, I246A, I246L, I246V,
I246V/R248M/Y273V, R248M, R248V, K249G, K249M,
K249M/Y273K, K249T, E256C, A262L, A262P, A262T,
A262V, L264A, L264E, L264G, L264N, L264P, L264R,
L264W, L265R, D266G, D266S, E271C, Y273L, Y273M,
Y273T, Y273V, A284G, G301E, G301M, E316R, E320R,
E320W, P321L, P321V, P321Y, L324C, L324V, L324W, and
Q329R, wherein the amino acid positions of said polypep-
tide sequence are numbered with reference to SEQ ID NO:6.
In some embodiments, the engineered polypeptide com-
prises a polypeptide sequence having at least 85%, 86%,
87%, 88%, 89%, 90%, 91%, 92%, 93%, 94%, 95%, 96%,
97%, 98%, 99%, or more sequence identity to SEQ ID
NO:6. In some embodiments, the engineered polypeptide
comprises a polypeptide sequence having at least 90%, 91%,
92%, 93%, 94%, 95%, 96%, 97%, 98%, 99%, or more
sequence identity to SEQ ID NO:6. In some embodiments,
the engineered polypeptide comprises a polypeptide
sequence having at least 95%, 96%, 97%, 98%, 99%, or
more sequence identity to SEQ ID NO:6.

In some additional embodiments, the present invention
provides engineered polypeptides having at least 85%, 86%,
87%, 88%, 89%, 90%, 91%, 92%, 93%, 94%, 95%, 96%,
97%, 98%, 99%, or more sequence identity to SEQ ID
NO:332, wherein the engineered polypeptide comprises at
least one substitution or substitution set at one or more
positions in said polypeptide sequence selected from 9/89/
93/101/160, 9/89/160, 33, 35, 44, 49, 74, 89, 89/93/160/249,
107, 108, 117, 140, 141, 142, 144, 156, 168, 203, 207, 234,
270, 273, 274, 292, 296, 297, 300, 302, 305, 317, 319, 321,
323, 327, and 329, wherein the amino acid positions of said
polypeptide sequence are numbered with reference to SEQ
ID NO:332. In some embodiments, the polypeptide
sequence of the engineered polypeptide has at least 85%,
86%, 87%, 88%, 89%, 90%, 91%, 92%, 93%, 94%, 95%,
96%, 97%, 98%, 99%, or more sequence identity to SEQ ID
NO:332, and wherein the polypeptide sequence of the engi-
neered polypeptide comprises at least one substitution or
substitution set at one or more positions in said polypeptide
sequence selected from 9H/89M/93M/101S/160Y, 9H/89Q/
160Y, 33N, 35H, 35M, 44T, 49P, 74K, 74R, 89L, 89M/93M/
160V/249M, 89V, 89W, 107M, 107R, 107V, 108L, 117D,
140L, 140M, 140S, 141A, 141H, 142N, 142S, 144A, 156C,
156T, 168P, 168R, 203L, 207G, 234I, 234T, 270R, 270S,
273L, 274A, 274G, 292T, 296M, 296V, 296W, 297L, 297T,
300T, 302I, 302L, 302Q, 305Q, 305T, 317W, 319T, 321A,
321S, 321T, 323R, 323V, 327H, 327Q, 327S, 329R, and
329V, wherein the amino acid positions of said polypeptide
sequence are numbered with reference to SEQ ID NO:332.
In some embodiments, the polypeptide sequence of the
engineered polypeptide has at least 85%, 86%, 87%, 88%,
89%, 90%, 91%, 92%, 93%, 94%, 95%, 96%, 97%, 98%,
99%, or more sequence identity to SEQ ID NO:332, and
wherein the polypeptide sequence of the engineered poly-
peptide comprises at least one substitution or substitution set
at one or more positions in said polypeptide sequence
selected from E9H/S89M/S93M/T101S/F160Y, E9H/S89Q/
F160Y, P33N, A35H, A35M, A44T, S49P, N74K, N74R,
S89L, S89M/S93M/F160V/K249M, S89V, S89W, E107M,
E107R, E107V, I108L, E117D, I140L, I140M, I140S,
T141A, T141H, K142N, K142S, R144A, Q156C, Q156T,
H168P, H168R, H203L, F207G, V234I, V234T, A270R,
A270S, Y273L, D274A, D274G, S292T, N296M, N296V,
N296W, S297L, S297T, D300T, V302I, V302L, V302Q,
P305Q, P305T, L317W, V319T, P321A, P321S, P321T,
S323R, S323V, P327H, P327Q, P327S, Q329R, and Q329V,
wherein the amino acid positions of said polypeptide
sequence are numbered with reference to SEQ ID NO:332.
In some embodiments, the engineered polypeptide com-
prises a polypeptide sequence having at least 85%, 86%,
87%, 88%, 89%, 90%, 91%, 92%, 93%, 94%, 95%, 96%,
97%, 98%, 99%, or more sequence identity to SEQ ID
NO:332. In some embodiments, the engineered polypeptide
comprises a polypeptide sequence having at least 90%, 91%,
92%, 93%, 94%, 95%, 96%, 97%, 98%, 99%, or more
sequence identity to SEQ ID NO:332. In some embodi-
ments, the engineered polypeptide comprises a polypeptide
sequence having at least 95%, 96%, 97%, 98%, 99%, or
more sequence identity to SEQ ID NO:332.

In some additional embodiments, the present invention
provides engineered polypeptides having at least 85%, 86%,
87%, 88%, 89%, 90%, 91%, 92%, 93%, 94%, 95%, 96%,
97%, 98%, 99%, or more sequence identity to SEQ ID
NO:518, wherein the engineered polypeptide comprises at
least one substitution or substitution set at one or more
positions in said polypeptide sequence selected from 35/273,
46/273, 111/159/273, 159, 159/273, 174, 199, 273, and 287,
wherein the amino acid positions of said polypeptide
sequence are numbered with reference to SEQ ID NO:518.
In some embodiments, the polypeptide sequence of the
engineered polypeptide has at least 85%, 86%, 87%, 88%,
89%, 90%, 91%, 92%, 93%, 94%, 95%, 96%, 97%, 98%,
99%, or more sequence identity to SEQ ID NO:518, and
wherein the polypeptide sequence of the engineered poly-
peptide comprises at least one substitution or substitution set
at one or more positions in said polypeptide sequence
selected from 35H/273L, 46L/273L, 111Q/159D/273L, 159D, 159D/273L, 174G, 199L, 273L, and 287P, wherein the amino acid positions of said polypeptide sequence are numbered with reference to SEQ ID NO:518. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:518, and wherein the polypeptide sequence of the engineered polypeptide comprises at least one substitution or substitution set at one or more positions in said polypeptide sequence selected from A35H/Y273L, V46L/Y273L, E111Q/P159D/Y273L, P159D, P159D/Y273L, S174G, I199L, Y273L, and V287P, wherein the amino acid positions of said polypeptide sequence are numbered with reference to SEQ ID NO:518. In some embodiments, the engineered polypeptide comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:518. In some embodiments, the engineered polypeptide comprises a polypeptide sequence having at least 90%, 91%, 92%, 93%, 94%, 95%, 96%, 97%, 98%, 99%, or more sequence identity to SEQ ID NO:518. In some embodiments, the engineered polypeptide comprises a polypeptide sequence having at least 95%, 96%, 97%, 98%, 99%, or more sequence identity to SEQ ID NO:518.

In some additional embodiments, the present invention provides engineered polypeptides having at least 85%, 86%, 87%, 88%, 89%, 90%, 91%, 92%, 93%, 94%, 95%, 96%, 97%, 98%, 99%, or more sequence identity to SEQ ID NO:332, wherein said engineered polypeptides have increased thermoactivity in wet organic solvents compared to the engineered polypeptide of SEQ ID NO:332, and wherein the engineered polypeptide comprises at least one substitution or substitution set at one or more positions in said polypeptide sequence selected from 23/29/55, 34, 44, 74, 92, 108, 117, 140, 141, 144, 156, 160, 168, 215, 256, 269, 270, 274, 292, 296, 302, 319, 323, and 329, wherein the amino acid positions of said polypeptide sequence are numbered with reference to SEQ ID NO:332. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:332, and wherein the polypeptide sequence of the engineered polypeptide comprises at least one substitution or substitution set at one or more positions in said polypeptide sequence selected from 23Y/29Y/55K, 34Y, 44N, 74K, 74R, 92D, 108L, 117R, 140L, 141H, 144V, 156T, 160V, 160W, 160Y, 168Q, 215A, 215S, 21ST, 256G, 269T, 270Q, 270S, 274A, 292T, 296M, 296V, 296Y, 302L, 302Q, 302S, 319R, 323L, 329R, and 329V, wherein the amino acid positions of said polypeptide sequence are numbered with reference to SEQ ID NO:332. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:332, and wherein the polypeptide sequence of the engineered polypeptide comprises at least one substitution or substitution set at one or more positions in said polypeptide sequence selected from Q23Y/D29Y/I55K, L34Y, A44N, N74K, N74R, E92D, I108L, E117R, I140L, T141H, R144V, Q156T, F160V, F160W, F160Y, H168Q, G215A, G215S, G215T, E256G, P269T, A270Q, A270S, D274A, S292T, N296M, N296V, N296Y, V302L, V302Q, V302S, V319R, S323L, Q329R, and Q329V, wherein the amino acid positions of said polypeptide sequence are numbered with reference to SEQ ID NO:332. In some embodiments, the engineered polypeptide comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:332. In some embodiments, the engineered polypeptide comprises a polypeptide sequence having at least 90%, 91%, 92%, 93%, 94%, 95%, 96%, 97%, 98%, 99%, or more sequence identity to SEQ ID NO:332. In some embodiments, the engineered polypeptide comprises a polypeptide sequence having at least 95%, 96%, 97%, 98%, 99%, or more sequence identity to SEQ ID NO:332.

In some additional embodiments, the present invention provides engineered polypeptides having at least 85%, 86%, 87%, 88%, 89%, 90%, 91%, 92%, 93%, 94%, 95%, 96%, 97%, 98%, 99%, or more sequence identity to SEQ ID NO:518, wherein said engineered polypeptides have increased thermoactivity in wet organic solvents compared to the engineered polypeptide of SEQ ID NO:518, and wherein the engineered polypeptide comprises at least one substitution or substitution set at one or more positions in said polypeptide sequence selected from 34/74/92, 35/273/323, 39, 46/273, 48, 55, 74/92, 126, 133, 138, 150, 160/215/329, 178, 199, 207, 273, and 292, wherein the amino acid positions of said polypeptide sequence are numbered with reference to SEQ ID NO:518. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:518, and wherein the polypeptide sequence of the engineered polypeptide comprises at least one substitution or substitution set at one or more positions in said polypeptide sequence selected from 34Y/74K/92D, 35H/273L/323R, 39G, 46L/273L, 48G, 55V, 74K/92D, 126L, 126V, 133T, 138A, 150W, 160V/215S/329R, 178S, 199L, 207Y, 273L, and 292T, wherein the amino acid positions of said polypeptide sequence are numbered with reference to SEQ ID NO:518. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:518, and wherein the polypeptide sequence of the engineered polypeptide comprises at least one substitution or substitution set at one or more positions in said polypeptide sequence selected from L34Y/N74K/E92D, A35H/Y273L/S323R, A39G, V46L/Y273L, P48G, I55V, N74K/E92D, T126L, T126V, S133T, R138A, F150W, Y160V/G215S/Q329R, T178S, I199L, F207Y, Y273L, and S292T, wherein the amino acid positions of said polypeptide sequence are numbered with reference to SEQ ID NO:518. In some embodiments, the engineered polypeptide comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:518. In some embodiments, the engineered polypeptide comprises a polypeptide sequence having at least 90%, 91%, 92%, 93%, 94%, 95%, 96%, 97%, 98%, 99%, or more sequence identity to SEQ ID NO:518. In some embodiments, the engineered polypeptide comprises a polypeptide sequence having at least 95%, 96%, 97%, 98%, 99%, or more sequence identity to SEQ ID NO:518.

In some additional embodiments, the present invention provides engineered polypeptides having at least 85%, 86%, 87%, 88%, 89%, 90%, 91%, 92%, 93%, 94%, 95%, 96%, 97%, 98%, 99%, or more sequence identity to SEQ ID NO:656, wherein said engineered polypeptides have increased thermoactivity in wet organic solvents compared to the engineered polypeptide of SEQ ID NO:656, and wherein the engineered polypeptide comprises at least one substitution or substitution set at one or more positions in said polypeptide sequence selected from 18, 35/39/55/138/ 150, 35/39/55/150, 35/39/126/150/273, 35/39/133, 35/39/ 133/150/273, 35/39/150, 35/39/150/273, 35/133/178, 35/138/150/273, 35/150/273, 35/178/273, 35/273, 39, 39/55/150/178/273, 39/55/150/273, 39/126/150, 39/133/ 150, 39/133/178/273, 39/133/273, 39/150/178, 39/150/178/ 207, 39/150/178/207/273, 39/150/273, 39/178, 39/178/273, 39/207, 39/207/273, 39/273, 44, 55, 55/150, 88, 126, 126/ 133/178, 126/138/178, 126/178/207, 132, 138/150/178, 141, 150, 150/178/273/323, 150/178/323, 150/207/273, 150/273, 168, 178/273, 239, 261, 263, 269, 273, 297, and 312, wherein the amino acid positions of said polypeptide sequence are numbered with reference to SEQ ID NO:656. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:656, and wherein the polypeptide sequence of the engineered polypeptide comprises at least one substitution or substitution set at one or more positions in said polypeptide sequence selected from 18R, 35H/39G/55V/138A/150W, 35H/39G/ 55V/150W, 35H/39G/126V/150W/273L, 35H/39G/133T, 35H/39G/133T/150W/273L, 35H/39G/150W, 35H/39G/ 150W/273L, 35H/133T/178S, 35H/138A/150W/273L, 35H/ 150W/273L, 35H/178S/273L, 35H/273L, 39G, 39G/55V/ 150W/178S/273L, 39G/55V/150W/273L, 39G/126V/150W, 39G/133T/150W, 39G/133T/178S/273L, 39G/133T/273L, 39G/150W/178S, 39G/150W/178S/207Y, 39G/150W/178S/ 207Y/273L, 39G/150W/273L, 39G/178S, 39G/178S/273L, 39G/207Y, 39G/207Y/273L, 39G/273L, 44L, 44Q, 55F, 55V, 55V/150W, 88W, 126V, 126V/133T/178S, 126V/ 138A/178S, 126V/178S/207Y, 132D, 132E, 138A/150W/ 178S, 141S, 150W, 150W/178S/273L/323R, 150W/178S/ 323R, 150W/207Y/273L, 150W/273L, 168D, 178S/273L, 239N, 261R, 263E, 269V, 273L, 297E, 297R, and 312A, wherein the amino acid positions of said polypeptide sequence are numbered with reference to SEQ ID NO:656. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:656, and wherein the polypeptide sequence of the engineered polypeptide comprises at least one substitution or substitution set at one or more positions in said polypeptide sequence selected from L18R, A35H/A39G/I55V/R138A/F150W, A35H/A39G/I55V/F150W, A35H/A39G/T126V/F150W/ Y273L, A35H/A39G/S133T, A35H/A39G/S133T/F150W/ Y273L, A35H/A39G/F150W, A35H/A39G/F150W/Y273L, A35H/S133T/T178S, A35H/R138A/F150W/Y273L, A35H/ F150W/Y273L, A35H/T178S/Y273L, A35H/Y273L, A39G, A39G/I55V/F150W/T178S/Y273L, A39G/I55V/ F150W/Y273L, A39G/T126V/F150W, A39G/S133T/ F150W, A39G/S133T/T178S/Y273L, A39G/S133T/Y273L, A39G/F150W/T178S, A39G/F150W/T178S/F207Y, A39G/ F150W/T178S/F207Y/Y273L, A39G/F150W/Y273L, A39G/T178S, A39G/T178S/Y273L, A39G/F207Y, A39G/ F207Y/Y273L, A39G/Y273L, A44L, A44Q, I55F, I55V, I55V/F150W, F88W, T126V, T126V/S133T/T178S, T126V/ R138A/T178S, T126V/T178S/F207Y, S132D, S132E, R138A/F150W/T178S, T141S, F150W, F150W/T178S/ Y273L/S323R, F150W/T178S/S323R, F150W/F207Y/ Y273L, F150W/Y273L, H168D, T178S/Y273L, G239N, E261R, I263E, P269V, Y273L, S297E, S297R, and R312A, wherein the amino acid positions of said polypeptide sequence are numbered with reference to SEQ ID NO:656. In some embodiments, the engineered polypeptide comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:656. In some embodiments, the engineered polypeptide comprises a polypeptide sequence having at least 90%, 91%, 92%, 93%, 94%, 95%, 96%, 97%, 98%, 99%, or more sequence identity to SEQ ID NO:656. In some embodiments, the engineered polypeptide comprises a polypeptide sequence having at least 95%, 96%, 97%, 98%, 99%, or more sequence identity to SEQ ID NO:656.

In some additional embodiments, the present invention provides engineered polypeptides having at least 85%, 86%, 87%, 88%, 89%, 90%, 91%, 92%, 93%, 94%, 95%, 96%, 97%, 98%, 99%, or more sequence identity to SEQ ID NO:2, wherein the engineered polypeptide comprises at least one substitution or substitution set at one or more positions in said polypeptide sequence selected from 9/20/ 23/39/55/89/134/150/155/160/178/199/244/273/284, 9/20/ 23/89/134/155/160/199/244/284, 9/20/23/89/134/155/160/ 244/284, 20/23/134/155/244/284, and 155/284, wherein the amino acid positions of said polypeptide sequence are numbered with reference to SEQ ID NO:2. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:2, and wherein the polypeptide sequence of the engineered polypeptide comprises at least one substitution or substitution set at one or more positions in said polypeptide sequence selected from 9H/20T/23Q/39G/55V/89Q/134S/150W/155W/160Y/178S/ 199L/244G/273L/284A, 9H/20T/23Q/89Q/134S/155W/ 160Y/199L/244G/284A, 9H/20T/23Q/89Q/134S/155W/ 160Y/244G/284A, 20T/23Q/134S/155W/244G/284A, and 155W/284A, wherein the amino acid positions of said polypeptide sequence are numbered with reference to SEQ ID NO:2. In some embodiments, the polypeptide sequence of the engineered polypeptide has at least 85%, 86%, 87%, 88%, 89%, 90%, 91%, 92%, 93%, 94%, 95%, 96%, 97%, 98%, 99%, or more sequence identity to SEQ ID NO:2, and wherein the polypeptide sequence of the engineered polypeptide comprises at least one substitution or substitution set at one or more positions in said polypeptide sequence selected from E9H/Y20T/Y23Q/A39G/I55V/S89Q/T134S/ F150W/L155W/F160Y/T178S/I199L/P244G/Y273L/ G284A, E9H/Y20T/Y23Q/S89Q/T134S/L155W/F160Y/ I199L/P244G/G284A, E9H/Y20T/Y23Q/S89Q/T134S/ L155W/F160Y/P244G/G284A, Y20T/Y23Q/T134S/ L155W/P244G/G284A, and L155W/G284A, wherein the amino acid positions of said polypeptide sequence are numbered with reference to SEQ ID NO:2. In some embodiments, the engineered polypeptide comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:2. In some embodiments, the engineered polypeptide comprises a polypeptide sequence having at least 90%, 91%, 92%, 93%, 94%, 95%, 96%, 97%, 98%, 99%, or more sequence identity to SEQ ID NO:2. In some embodiments, the engineered polypeptide comprises a polypeptide sequence having at least 95%, 96%, 97%, 98%, 99%, or more sequence identity to SEQ ID NO:2.

In some embodiments of the engineered polypeptides having transaminase activity of the present disclosure, the engineered polypeptide is capable of converting a substrate of compound (2) to a product of compound (1) under suitable reaction conditions. In some embodiments, the engineered polypeptide is capable of converting compound (2) to compound (1) with at least 1 fold, 2 fold, 3, fold, 5 fold, 7 fold, 10 fold, 12 fold, 15 fold, 20 fold, or greater the activity of SEQ ID NO:2 under suitable reaction conditions. In some embodiments, the engineered polypeptide is capable of converting compound (2) to compound (1) with increased activity relative to SEQ ID NO:2 in which the suitable reaction conditions comprise compound (1) at a loading of at least 20 g/L, wet isopropyl acetate (IPAc), 0.55 M isopropylamine (IPM), and 50° C.

In some embodiments of the present disclosure, the engineered polypeptide having transaminase activity is immobilized on a solid support, optionally wherein the solid support is selected from a bead or resin comprising polymethacrylate with epoxide functional groups, polymethacrylate with amino epoxide functional groups, styrene/DVB copolymer or polymethacrylate with octadecyl functional groups.

The present invention also provides polynucleotide sequences encoding at least one engineered polypeptide provided herein. In some embodiments, the polynucleotide sequence encoding at least one engineered polypeptide, comprises a polynucleotide sequence having at least 85%, 86%, 87%, 88%, 89%, 90%, 91%, 92%, 93%, 94%, 95%, 96%, 97%, 98%, 99%, or more sequence identity to SEQ ID NOS: 1, 5, 331, 517 and/or 655. In some embodiments, the polynucleotide sequence encoding at least one engineered polypeptide, comprises a polynucleotide sequence having at least 85%, 86%, 87%, 88%, 89%, 90%, 91%, 92%, 93%, 94%, 95%, 96%, 97%, 98%, 99%, or more sequence identity to SEQ ID NOS: 1, 5, 331, 517 and/or 655, wherein the polynucleotide sequence of said engineered polypeptide comprises at least one substitution at one or more positions. In some further embodiments, the polynucleotide sequence encoding at least one engineered polypeptide comprises at least 85%, 86%, 87%, 88%, 89%, 90%, 91%, 92%, 93%, 94%, 95%, 96%, 97%, 98%, 99%, or more sequence identity to SEQ ID NOS: 1, 5, 331, 517 and/or 655, or a functional fragment thereof. In some additional embodiments, the polynucleotide sequence comprises a polynucleotide sequence forth in the odd numbered sequences of SEQ ID NOS: 3-845.

In some additional embodiments, the engineered polynucleotide sequence is operably linked to a control sequence. In some embodiments, the control sequence comprises a promoter. In some additional embodiments, the promoter is a heterologous promoter. In some further embodiments, the control sequence comprises more than one control sequence. In some embodiments, one of the control sequences comprises a promoter and the other control sequence comprises a different control sequence. In some embodiments, the engineered polynucleotide sequence is codon optimized. The present invention also provides expression vectors comprising at least one polynucleotide sequence provided herein. The present invention also provides host cells comprising at least one expression vector provided herein. In some embodiments, the present invention provides host cells comprising at least one polynucleotide sequence provided herein. In some embodiments, the host cell is a prokaryotic cell, while in some other embodiments, the host cell is a eukaryotic cell. In some additional embodiments, the host cell is E. coli.

The present invention also provides methods of producing an engineered transaminase in a host cell, comprising culturing the host cell provided herein, in a culture medium under suitable conditions, such that at least one engineered transaminase provided herein is produced. In some embodiments, the methods further comprise the step of recovering at least one engineered transaminase from the culture medium and/or the host cell. In some additional embodiments, the methods further comprise the step of purifying the at least one transaminase obtained using the methods of the present invention.

The present disclosure also provides processes for using the engineered transaminase polypeptides disclosed herein for the preparation of a wide range of chiral amine compounds. In some embodiments, the present disclosure provides a process for preparing a compound of structural Formula (I):

having the indicated stereochemical configuration at the stereogenic center marked with an *; in an enantiomeric excess of at least 70% over the opposite enantiomer, wherein Z is a linear $C_{1-6}$ alkyl or a branched $C_{1-6}$ alkyl, optionally substituted with one or more hydroxy, cyano, or nitro groups; and $R^1$ is $C_{1-6}$ alkyl, aryl-$C_{1-2}$ alkyl, heteroaryl-$C_{1-2}$ alkyl, or a 5- to 6-membered heterocyclic ring system optionally containing an additional heteroatom selected from O, S, and N, the heterocyclic ring being unsubstituted or substituted with one to three substituents independently selected from oxo, hydroxy, halogen, $C_{1-4}$ alkoxy, and $C_{1-4}$ alkyl; the process comprising the step of contacting a prochiral keto ester of structural Formula (II):

with an engineered polypeptide as disclosed herein in the presence of an amino group donor under suitable reaction conditions.

In some embodiments, the present disclosure provides a process of preparing compound (1);

the process comprising a step of contacting a substrate of compound (2)

with an engineered polypeptide as disclosed herein in the presence of an amino group donor under suitable reaction conditions.

In some embodiments, the processes using the engineered polypeptides disclosed herein can be carried out wherein the chiral amine compound of Formula (I) or the Compound (1), is produced in at least 70%, 80%, 90%, 97%, 98%, 99% or greater enantiomeric excess.

Any of the processes disclosed herein using the engineered polypeptides for the preparation of compounds of Formula (I) or compound (1) can be carried out under a range of suitable reaction conditions, including but not limited to, ranges of amino group donor, temperature, wet organic solvent system, substrate loading, polypeptide loading, cofactor loading, and reaction time. In one example, in some embodiments, the preparation of compounds of Formula (I) or compound (1) can be carried out wherein the suitable reaction conditions comprise: (a) substrate loading of about 10 to 220 g/L of substrate compound (e.g., compound (2)); (b) of about 0.5 g/L to 25 g/L engineered polypeptide; (c) IPM concentration of about 0.1 to 3 M; (d) a wet organic solvent; and (e) temperature of about 30° C. to 60° C. In some embodiments, the suitable reaction conditions comprise: (a) about 20 g/L of substrate compound (e.g., compound (2)); (b) about 20 g/L engineered polypeptide; (c) wet IPAc; (d) about 0.55 M IPM; and (e) about 50° C.

In some embodiments, the processes using the engineered polypeptides disclosed herein can be carried out wherein the amino group donor is selected from IPM, alanine, 3-aminobutyric acid, or methylbenzylamine. In some embodiments, the amino group donor is IPM.

In some embodiments, the wet organic solvent is selected from wet IPAc, wet toluene, wet methyl tertiary-butyl ether (MTBE), wet acetonitrile (MeCN), or wet isopropyl alcohol (IPA). In some embodiments, the wet organic solvent is wet IPAc.

In some embodiments, the processes using the engineered polypeptides disclosed herein can be carried out wherein the process comprises further steps of isolating the product compounds of Formula (I) or compound (1), from the reaction.

Further guidance on the choice of engineered polypeptides, their preparation, the choice of substrates, and parameters for carrying out the processes are further described in the more detailed description and Examples that follow.

DESCRIPTION OF THE INVENTION

The present invention provides engineered transaminase polypeptides and compositions thereof, as well as polynucleotides encoding the engineered transaminase polypeptides. Methods for producing transaminase enzymes are also provided. In some embodiments, the engineered transaminase polypeptides are optimized to provide improved enzyme properties under minimal aqueous conditions in wet organic solvents.

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. Accordingly, the following terms are intended to have the meanings provided herein.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention. The section headings used herein are for organizational purposes only and not to be construed as limiting the subject matter described. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used in this specification and the appended claims, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," "including," "have," and "having" are interchangeable and not intended to be limiting. Thus, as used herein, the term "comprising" and its cognates are used in their inclusive sense (i.e., equivalent to the term "including" and its corresponding cognates).

It is to be further understood that where descriptions of various embodiments use the term "comprising," those skilled in the art would understand that in some specific instances, an embodiment can be alternatively described using language "consisting essentially of" or "consisting of."

All patents, patent applications, articles and publications mentioned herein, both supra and infra, are hereby expressly incorporated herein by reference.

Definitions and Abbreviations

The abbreviations used for the genetically encoded amino acids are conventional and are as follows: alanine (Ala or A), arginine (Are or R), asparagine (Asn or N), aspartate (Asp or D), cysteine (Cys or C), glutamate (Glu or E), glutamine (Gln or Q), glycine (Gly or G), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V).

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleotides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

As used herein, the term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein, "ATCC" refers to the American Type Culture Collection whose biorepository collection includes genes and strains.

As used herein, "NCBI" refers to National Center for Biological Information and the sequence databases provided therein.

"Protein", "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids, as well as polymers comprising D- and L-amino acids, and mixtures of D- and L-amino acids.

"Transaminase" or "aminotransferase" are used interchangeably herein to refer to a polypeptide having an enzymatic capability of transferring an amino group (—NH$_2$), a pair of electrons, and a proton from the primary amine of an amino group donor compound to the carbonyl group (C=O) of an amine acceptor compound, thereby converting the amino group donor compound into its corresponding carbonyl compound and the carbonyl acceptor compound into its corresponding primary amine compound (See e.g., Scheme 1). Transaminases as used herein include naturally occurring (wild type) transaminase as well as non-naturally occurring engineered polypeptides generated by human manipulation.

"Amino group donor" or "amino donor" used interchangeably herein to refer to an amino group containing compound which is capable of donating an amino group to an acceptor carbonyl compound (i.e., an amino group acceptor), thereby becoming a carbonyl by-product. Amino group donors have the general structural formula,

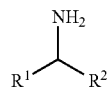

in which each of $R^1$, and $R^2$, when taken independently, is an alkyl, an alkylaryl group, or aryl group which is unsubstituted or substituted with one or more enzymatically non-inhibiting groups. $R^1$ can be the same or different from $R^2$ in structure or chirality. The groups $R^1$ and $R^2$, taken together, may form a ring that is unsubstituted, substituted, or fused to other rings. Typical amino group donors include chiral and achiral amino acids, and chiral and achiral amines.

"Chiral amine" refers to amines of general formula $R^1$—CH(NH$_2$)—$R^2$ and is employed herein in its broadest sense, including a wide variety of aliphatic and alicyclic compounds of different, and mixed, functional types, characterized by the presence of a primary amino group bound to a secondary carbon atom which, in addition to a hydrogen atom, carries either (i) a divalent group forming a chiral cyclic structure, or (ii) two substituents (other than hydrogen) differing from each other in structure or chirality. Divalent groups forming a chiral cyclic structure include, for example, 2-methylbutane-1,4-diyl, pentane-1,4-diyl, hexane-1,4-diyl, hexane-1,5-diyl, 2-methylpentane-1,5-diyl. The two different substituents on the secondary carbon atom ($R^1$ and $R^2$ above) also can vary widely and include alkyl, arylalkyl, aryl, halo, hydroxy, lower alkyl, lower alkyloxy, lower alkylthio, cycloalkyl, carboxy, carbalkyloxy, carbamoyl, mono- and di-(lower alkyl) substituted carbamoyl, trifluoromethyl, phenyl, nitro, amino, mono- and di-(lower alkyl) substituted amino, alkylsulfonyl, arylsulfonyl, alkylcarboxamido, arylcarboxamido, etc., as well as alkyl, arylalkyl, or aryl substituted by the foregoing.

"Carbonyl by-product" refers to the carbonyl compound formed from the amino group donor when the amino group on the amino group donor is transferred to the amino group acceptor in a transamination reaction. The carbonyl by-product has the general structural formula,

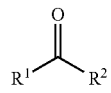

wherein $R^1$ and $R^2$ are defined above for the amino group donor.

"Amino acceptor" and "amine acceptor," "keto substrate," "keto ester substrate," are used interchangeably herein to refer to a carbonyl group containing compound that accepts the amino group from an amino group donor in a reaction mediated by a transaminase (See e.g., Scheme 1). In the context of the present disclosure, the amino acceptor compound for the transaminase can include, among others, the compound of Formula (II) and the compound (2), as further described herein.

"Cofactor," as used herein, refers to a non-protein compound that operates in combination with an enzyme in catalyzing a reaction. As used herein, "cofactor" is intended to encompass the vitamin B$_6$ family compounds PLP, PN, PL, PM, PNP, and PMP, which are sometimes also referred to as coenzymes.

"Pyridoxal-phosphate," "PLP," "pyridoxal-5'-phosphate," "PYP," and "P5P" are used interchangeably herein to refer to the compound that acts as a cofactor in transaminase reactions. In some embodiments, pyridoxal phosphate is defined by the structure 1-(4'-formyl-3'-hydroxy-2'-methyl-5'-pyridyl)methoxyphosphonic acid, CAS number [54-47-7]. Pyridoxal-5'-phosphate can be produced in vivo by phosphorylation and oxidation of pyridoxol (also known as Vitamin $B_6$). In transamination reactions using transaminase enzymes, the amine group of the amino donor is transferred to the cofactor to produce a keto byproduct, while pyridoxal-5'-phosphateconverted to pyridoxamine phosphate. Pyridoxal-5'-phosphateregenerated by reaction with a different keto compound (the amino acceptor). The transfer of the amine group from pyridoxamine phosphate to the amino acceptor produces an amine and regenerates the cofactor. In some embodiments, the pyridoxal-5'-phosphate can be replaced by other members of the vitamin $B_6$ family, including pyridoxine (PN), pyridoxal (PL), pyridoxamine (PM), and their phosphorylated counterparts; pyridoxine phosphate (PNP), and pyridoxamine phosphate (PMP).

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "hydrophilic amino acid or residue" refers to an amino acid or residue having a side chain exhibiting a hydrophobicity of less than zero according to the normalized consensus hydrophobicity scale of Eisenberg et al., (Eisenberg et al., I., 179:125-142 [1984]). Genetically encoded hydrophilic amino acids include L-Thr (T), L-Ser (S), L-His (H), L-Glu (E), L-Asn (N), L-Gln (Q), L-Asp (D), L-Lys (K) and L-Arg (R).

As used herein, "acidic amino acid or residue" refers to a hydrophilic amino acid or residue having a side chain exhibiting a pKa value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

As used herein, "basic amino acid or residue" refers to a hydrophilic amino acid or residue having a side chain exhibiting a pKa value of greater than about 6 when the amino acid is included in a peptide or polypeptide. Basic amino acids typically have positively charged side chains at physiological pH due to association with hydronium ion. Genetically encoded basic amino acids include L-Arg (R) and L-Lys (K).

As used herein, "polar amino acid or residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (Q), L-Ser (S) and L-Thr (T).

As used herein, "hydrophobic amino acid or residue" refers to an amino acid or residue having a side chain exhibiting a hydrophobicity of greater than zero according to the normalized consensus hydrophobicity scale of Eisenberg et al., (Eisenberg et al., *J. Mol. Biol.,* 179:125-142 [1984]). Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

As used herein, "aromatic amino acid or residue" refers to a hydrophilic or hydrophobic amino acid or residue having a side chain that includes at least one aromatic or heteroaromatic ring. Genetically encoded aromatic amino acids include L-Phe (F), L-Tyr (Y) and L-Trp (W). Although owing to the pKa of its heteroaromatic nitrogen atom L-His (H) it is sometimes classified as a basic residue, or as an aromatic residue as its side chain includes a heteroaromatic ring, herein histidine is classified as a hydrophilic residue or as a "constrained residue" (see below).

As used herein, "constrained amino acid or residue" refers to an amino acid or residue that has a constrained geometry. Herein, constrained residues include L-Pro (P) and L-His (H). Histidine has a constrained geometry because it has a relatively small imidazole ring. Proline has a constrained geometry because it also has a five membered ring.

As used herein, "non-polar amino acid or residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Gly (G), L-Leu (L), L-Val (V), L-Ile (I), L-Met (M) and L-Ala (A).

As used herein, "aliphatic amino acid or residue" refers to a hydrophobic amino acid or residue having an aliphatic hydrocarbon side chain. Genetically encoded aliphatic amino acids include L-Ala (A), L-Val (V), L-Leu (L) and L-Ile (I). It is noted that cysteine (or "L-Cys" or "[C]") is unusual in that it can form disulfide bridges with other L-Cys (C) amino acids or other sulfanyl- or sulfhydryl-containing amino acids. The "cysteine-like residues" include cysteine and other amino acids that contain sulfhydryl moieties that are available for formation of disulfide bridges. The ability of L-Cys (C) (and other amino acids with —SH containing side chains) to exist in a peptide in either the reduced free —SH or oxidized disulfide-bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present disclosure, L-Cys (C) is categorized into its own unique group.

As used herein, "small amino acid or residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include L-Ala (A), L-Val (V), L-Cys (C), L-Asn (N), L-Ser (S), L-Thr (T) and L-Asp (D).

As used herein, "hydroxyl-containing amino acid or residue" refers to an amino acid containing a hydroxyl (—OH) moiety. Genetically-encoded hydroxyl-containing amino acids include L-Ser (S) L-Thr (T) and L-Tyr (Y).

As used herein, "polynucleotide" and "nucleic acid" refer to two or more nucleotides that are covalently linked together. The polynucleotide may be wholly comprised of ribonucleotides (i.e., RNA), wholly comprised of 2'-deoxyribonucleotides (i.e., DNA), or comprised of mixtures of ribo- and 2'-deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

As used herein, "nucleoside" refers to glycosylamines comprising a nucleobase (i.e., a nitrogenous base), and a 5-carbon sugar (e.g., ribose or deoxyribose). Non-limiting examples of nucleosides include cytidine, uridine, adenosine, guanosine, thymidine, and inosine. In contrast, the term "nucleotide" refers to the glycosylamines comprising a nucleobase, a 5-carbon sugar, and one or more phosphate groups. In some embodiments, nucleosides can be phosphorylated by kinases to produce nucleotides.

As used herein, "nucleoside diphosphate" refers to glycosylamines comprising a nucleobase (i.e., a nitrogenous base), a 5-carbon sugar (e.g., ribose or deoxyribose), and a diphosphate (i.e., pyrophosphate) moiety. In some embodiments herein, "nucleoside diphosphate" is abbreviated as "NDP." Non-limiting examples of nucleoside diphosphates include cytidine diphosphate (CDP), uridine diphosphate (UDP), adenosine diphosphate (ADP), guanosine diphosphate (GDP), thymidine diphosphate (TDP), and inosine diphosphate. The terms "nucleoside" and "nucleotide" may be used interchangeably in some contexts.

"Coding sequence" refers to that portion of a nucleic acid (e.g., a gene) that encodes an amino acid sequence of a protein.

As used herein, the terms "biocatalysis," "biocatalytic," "biotransformation," and "biosynthesis" refer to the use of enzymes to perform chemical reactions on organic compounds.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

As used herein, "recombinant," "engineered," "non-naturally occurring," and "variant," when used with reference to a cell, nucleic acid, or polypeptide, refers to a material, or a material corresponding to the natural or native form of the material, that has been modified in a manner that would not otherwise exist in nature. In some embodiments, the cell, nucleic acid or polypeptide is identical a naturally occurring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

The term "percent (%) sequence identity" is used herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted by any suitable method, including, but not limited to the local homology algorithm of Smith and Waterman (Smith and Waterman, *Adv. Appl. Math.*, 2:482 [1981]), by the homology alignment algorithm of Needleman and Wunsch (Needleman and Wunsch, *J. Mol. Biol.*, 48:443 [1970]), by the search for similarity method of Pearson and Lipman (Pearson and Lipman, *Proc. Natl. Acad. Sci.* USA 85:2444 [1988]), by computerized implementations of these algorithms (e.g., GAP, BEST-FIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See Altschul et al., *J. Mol. Biol.*, 215: 403-410 [1990]; and Altschul et al., *Nucl. Acids Res.*, 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always>0) and N (penalty score for mismatching residues; always<0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix (See, Henikoff and Henikoff, *Proc. Natl. Acad. Sci.* USA 89:10915 [1989]). Exemplary determination of sequence alignment and % sequence identity can employ the BEST-FIT or GAP programs in the GCG Wisconsin Software package (Accelrys, Madison WI), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, a "reference sequence based on SEQ ID NO:2 having at the residue corresponding to X9 a histidine" refers to a reference sequence in which the corresponding residue at X9 in SEQ ID NO:2, which is a tyrosine, has been changed to histidine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered transaminase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "amino acid difference" and "residue difference" refer to a difference in the amino acid residue at a position of a polypeptide sequence relative to the amino acid residue at a corresponding position in a reference sequence. In some cases, the reference sequence has a histidine tag, but the numbering is maintained relative to the equivalent reference sequence without the histidine tag. The positions of amino acid differences generally are referred to herein as "Xn," where n refers to the corresponding position in the reference sequence upon which the residue difference is based. For example, a "residue difference at position X93 as compared to SEQ ID NO:4" refers to a difference of the amino acid residue at the polypeptide position corresponding to position 93 of SEQ ID NO:4. Thus, if the reference polypeptide of SEQ ID NO:4 has a serine at position 93, then a "residue difference at position X93 as compared to SEQ ID NO:4" an amino acid substitution of any residue other than serine at the position of the polypeptide corresponding to position 93 of SEQ ID NO:4. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in the Tables presented in the Examples), the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). The slash may also be used to indicate multiple substitutions within a given variant (i.e., there is more than one substitution present in a given sequence, such as in a combinatorial variant). In some embodiments, the present invention includes engineered polypeptide sequences comprising one or more amino acid differences comprising conservative or non-conservative amino acid substitutions. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with an hydroxyl side chain is substituted with another amino acid with an hydroxyl side chain (e.g., serine and threonine); an amino acid having aromatic side chains is substituted with another amino acid having an aromatic side chain (e.g., phenylalanine, tyrosine, tryptophan, and histidine); an amino acid with a basic side chain is substituted with another amino acid with a basic side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered transaminase enzyme. Deletions can be directed to the internal portions and/or terminal portions of the polypeptide. In various embodiments, the deletion can comprise a continuous segment or can be discontinuous. Deletions are typically indicated by "—" in amino acid sequences.

"Insertion" refers to modification to the polypeptide by addition of one or more amino acids from the reference polypeptide. In some embodiments, the improved engineered transaminase enzymes comprise insertions of one or more amino acids to the naturally occurring transaminase polypeptide as well as insertions of one or more amino acids to other improved transaminase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The term "amino acid substitution set" or "substitution set" refers to a group of amino acid substitutions in a polypeptide sequence, as compared to a reference sequence. A substitution set can have 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant transaminases listed in the Tables provided in the Examples.

A "functional fragment" and "biologically active fragment" are used interchangeably herein to refer to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered transaminase of the present invention) and that retains substantially all of the activity of the full-length polypeptide.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The improved transaminase enzymes may be present within a cell, present in the cellular medium, or prepared in various forms, such as lysates or isolated preparations. As such, in some embodiments, the improved transaminase enzyme can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. However, in some embodiments, the composition comprising transaminase comprises transaminase that is less than 50% pure (e.g., about 10%, about 20%, about 30%, about 40%, or about 50%). Generally, a substantially pure transaminase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated improved transaminase polypeptide is a substantially pure polypeptide composition.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Where a mixture contains more than two diastereomers it is common to report the ratio of diastereomers or "diastereomeric ratio" rather than diastereomeric excess. Enantiomeric excess and diastereomeric excess are types of stereomeric excess. "Highly stereoselective" refers to a transaminase polypeptide that is capable of converting the substrate to the corresponding chiral amine product with at least about 85% stereomeric excess.

As used herein, "regioselectivity" and "regioselective reaction" refer to a reaction in which one direction of bond making or breaking occurs preferentially over all other possible directions. Reactions can be completely (100%) regioselective if the discrimination is complete, substantially regioselective (at least 75%), or partially regioselective (x %, wherein the percentage is set dependent upon the reaction of interest), if the product of reaction at one site predominates over the product of reaction at other sites.

As used herein, "chemoselectivity" refers to the preferential formation in a chemical or enzymatic reaction of one product over another.

As used herein, "improved enzyme property" refers to at least one improved property of an enzyme. In some embodiments, the present invention provides engineered transaminase polypeptides that exhibit an improvement in any enzyme property as compared to a reference transaminase polypeptide and/or a wild-type transaminase polypeptide, and/or another engineered transaminase polypeptide. Thus, the level of "improvement" can be determined and compared between various transaminase polypeptides, including wild-type, as well as engineered transaminase. Improved properties include, but are not limited, to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, and altered temperature profile. In additional embodiments, the term is used in reference to the at least one improved property of transaminase enzymes. In some embodiments, the present invention provides engineered transaminase polypeptides that exhibit an improvement in any enzyme property as compared to a reference transaminase polypeptide and/or a wild-type transaminase polypeptide, and/or another engineered transaminase polypeptide. Thus, the level of "improvement" can be determined and compared between various transaminase polypeptides, including wild-type, as well as engineered transaminase.

"Increased enzymatic activity" and "enhanced catalytic activity" refer to an improved property of the engineered polypeptides, which can be represented by an increase in specific activity (e.g., product produced/time/weight protein) or an increase in percent conversion of the substrate to the product (e.g., percent conversion of starting amount of substrate to product in a specified time period using a specified amount of enzyme) as compared to the reference enzyme. In some embodiments, the terms refer to an improved property of engineered transaminase polypeptides provided herein, which can be represented by an increase in specific activity (e.g., product produced/time/weight protein) or an increase in percent conversion of the substrate to the product (e.g., percent conversion of starting amount of substrate to product in a specified time period using a specified amount of transaminase) as compared to the reference transaminase enzyme. In some embodiments, the terms are used in reference to improved transaminase enzymes provided herein. Exemplary methods to determine enzyme activity of the engineered transaminase of the present invention are provided in the Examples. Any property relating to enzyme activity may be affected, including the classical enzyme properties of $K_m$, $V_{max}$ or $k_{cat}$, changes of which can lead to increased enzymatic activity. For example, improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring transaminase or another engineered transaminase from which the transaminase polypeptides were derived.

"Increased thermoactivity" or "improved thermoactivity" is used herein to refer to a polypeptide with increased catalytic activity relative to a reference or wild-type protein under high temperature conditions.

"Conversion" refers to the enzymatic conversion of the substrate(s) to the corresponding product(s). "Percent conversion" refers to the percent of the substrate that is converted to the product within a period of time under specified conditions. Thus, the "enzymatic activity" or "activity" of a transaminase polypeptide can be expressed as "percent conversion" of the substrate to the product.

"Thermostable" refers to a transaminase polypeptide that maintains similar activity (more than 60% to 80% for example) after exposure to elevated temperatures (e.g., 40-80° C.) for a period of time (e.g., 0.5-24 hrs) compared to the wild-type enzyme.

"Solvent stable" refers to a transaminase polypeptide that maintains similar activity (more than e.g., 60% to 80%) after exposure to varying concentrations (e.g., 5-99%) of solvent (ethanol, IPA, dimethylsulfoxide (DMSO), tetrahydrofuran, 2-methyltetrahydrofuran, acetone, toluene, butyl acetate, methyl tert-butyl ether, etc.) for a period of time (e.g., 0.5-24 hrs) compared to the wild type enzyme.

As used herein, "pH stable" refers to a transaminase polypeptide that maintains similar activity (e.g., more than 60% to 80%) after exposure to high or low pH (e.g., 4.5-6 or 8 to 12) for a period of time (e.g., 0.5-24 hrs) compared to the untreated enzyme.

The term "stringent hybridization conditions" is used herein to refer to conditions under which nucleic acid hybrids are stable. As known to those of skill in the art, the stability of hybrids is reflected in the melting temperature (Tm) of the hybrids. In general, the stability of a hybrid is a function of ion strength, temperature, G/C content, and the presence of chaotropic agents. The Tm values for polynucleotides can be calculated using known methods for predicting melting temperatures (See e.g., Baldino et al., *Meth. Enzymol.*, 168:761-777 [1989]; Bolton et al., *Proc. Natl. Acad. Sci.* USA 48:1390 [1962]; Bresslauer et al., *Proc. Natl. Acad. Sci.* USA 83:8893-8897 [1986]; Freier et al., *Proc. Natl. Acad. Sci.* USA 83:9373-9377 [1986]; Kierzek et al., *Biochem.*, 25:7840-7846 [1986]; Rychlik et al., *Nucl. Acids Res.*, 18:6409-6412 [1990] (erratum, *Nucl. Acids Res.*, 19:698 [1991]); Sambrook et al., supra); Suggs et al., 1981, in *Developmental Biology Using Purified Genes*, Brown et al. [eds.], pp. 683-693, Academic Press, Cambridge, MA [1981]; and Wetmur, *Crit. Rev. Biochem. Mol. Biol.* 26:227-259 [1991]). In some embodiments, the polynucleotide encodes the polypeptide disclosed herein and hybridizes under defined conditions, such as moderately stringent or highly stringent conditions, to the complement of a sequence encoding an engineered transaminase enzyme of the present invention.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is more efficiently expressed in the organism of interest. Although the genetic code is degenerate in that most amino acids are represented by several codons, called "synonyms"

or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the transaminases enzymes may be codon optimized for optimal production from the host organism selected for expression.

As used herein, "preferred," "optimal," and "high codon usage bias" codons when used alone or in combination refer(s) interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; and Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in Escherichia coli and Salmonella, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, Bioinformatics: Sequence and Genome Analysis, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

"Control sequence" refers herein to include all components, which are necessary or advantageous for the expression of a polynucleotide and/or polypeptide of the present disclosure. Each control sequence may be native or foreign to the nucleic acid sequence encoding the polypeptide. Such control sequences include, but are not limited to, a leader, polyadenylation sequence, propeptide sequence, promoter, signal peptide sequence, initiation sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Alkyl" refers to groups of from 1 to 18 carbon atoms, either straight chained or branched, particularly from 1 to 8 carbon atoms, and more particularly 1 to 6 carbon atoms. An alkyl with a specified number of carbon atoms is denoted in parenthesis, e.g., (C1-C4) alkyl refers to an alkyl of 1 to 4 carbon atoms.

"Aryl" refers to an unsaturated aromatic carbocyclic group of from 5 to 14 carbon atoms having a single ring (e.g., phenyl) or multiple condensed rings (e.g., naphthyl or anthryl). For multiple condensed rings, at least one of the rings is aromatic. Representative aryls include phenyl, pyridyl, naphthyl and the like.

"Arylalkyl" refers to an alkyl substituted with an aryl moiety. Representative arylalkyl groups include benzyl, phenethyl and the like.

"Heteroaryl" refers to an aromatic heterocyclic group of 5 to 14 ring atoms containing 1 to 4 ring heteroatoms selected from oxygen, nitrogen and sulfur within the ring. Heteroaryl groups can have a single ring (e.g., pyridyl or furyl) or multiple condensed rings (e.g., indolizinyl or benzothienyl). For multiple condensed rings, at least one of the rings is aromatic.

"Heteroarylalkyl" refers to an alkyl substituted with a heteroaryl moiety as defined herein.

"Heterocycle" and interchangeably "heterocycloalkyl" refer to a saturated or unsaturated group having a single ring or multiple condensed rings, from 3 to 14 ring atoms having from 1 to 4 hetero atoms selected from nitrogen, sulfur or oxygen within the ring. Heterocyclic groups can have a single ring (e.g., piperidinyl or tetrahydrofuryl) or multiple condensed rings (e.g., indolinyl, dihydrobenzofuran or quinuclidinyl). Representative heterocycles and heteroaryls include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, "Alkoxy" or "Alkyloxy" refers to the group alkyl-O— wherein the alkyl group is as defined above, including optionally substituted alkyl groups as also defined above.

"Amino" refers to the group —NH$_2$. Substituted amino refers to the group —NHR', NR'R', and NR'R'R', where each R' is independently of the others selected from substituted or unsubstituted alkyl, cycloalkyl, heterocycloalkyl, cycloalkylalkyl, heterocycloalkylalkyl, alkyloxy, aryl, heteroaryl, arylalkyl, heteroarylalkyl, acyl, alkyloxycarbonyl, sulfanyl, sulfinyl, sulfonyl, and the like. Typical amino groups include, but are not limited to, dimethylamino, diethylamino, trimethylammonium, triethylammonium, methylsulfonylamino, furanyl-oxy-sulfamino, and the like.

"Carboxy" refers to —COOH.

"Carbonyl" refers to —C(O)—, which may have a variety of substituents to form different carbonyl groups including acids, acid halides, aldehydes, amides, esters, and ketones.

"Hydroxy" refers to —OH.

"Cyano" refers to —CN.

"Halogen" or "halo" refers to fluoro, chloro, bromo and iodo.

"Nitro" refers to —NO$_2$

"Fused" or "fused rings" such as in fused aryl or fused heteroaryl refers to two or more rings joined such that they have at least two ring atoms in common. Fused aryl refers to fused rings in which at least one of the rings is an aryl. Fused heteroaryl refers to fused rings in which at least one of the rings is a heteroaryl.

"Substituted" unless otherwise specified, refers to replacement of positions occupied by hydrogen in the foregoing groups with substituents exemplified by, but not limited to, hydroxy, oxo, nitro, methoxy, ethoxy, alkyloxy, substituted alkyloxy, trifluoromethoxy, haloalkyloxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkyloxyalkyl, thio, alkylthio, acyl, carboxy, alkyloxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present invention, and is otherwise chemically reasonable.

"Optional" or "optionally" means that the subsequently described event or circumstance may or may not occur, and that the description includes instances where said event or circumstance occurs and instances in which it does not. One of ordinary skill in the art would understand that with respect to any molecule described as containing one or more optional substituents, only sterically practical and/or synthetically feasible compounds are meant to be included.

"Optionally substituted" refers to all subsequent modifiers in a term or series of chemical groups. For example, in the term "optionally substituted arylalkyl, the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

"Protecting group" refers to a group of atoms that mask, reduce or prevent the reactivity of the functional group when attached to a reactive functional group in a molecule. Typically, a protecting group may be selectively removed as desired during the course of a synthesis. Examples of protecting groups can be found in Wuts and Greene, *Greene's Protective Groups in Organic Synthesis*, 4$^{th}$ Ed., Wiley Interscience (2006), and Harrison et al., *Compendium of Synthetic Organic Methods*, Vols. 1-8, 1971-1996, John Wiley & Sons, NY. Functional groups that can have a protecting group include, but are not limited to, hydroxy, amino, and carboxy groups. Representative amino protecting groups include, but are not limited to, formyl, acetyl, trifluoroacetyl, benzyl, benzyloxycarbonyl ("CBZ"), tert-butoxycarbonyl ("Boc"), trimethylsilyl ("TMS"), 2-trimethylsilyl-ethanesulfonyl ("SES"), trityl and substituted trityl groups, allyloxycarbonyl, 9-fluorenylmethyloxycarbonyl ("FMOC"), nitro-veratryloxycarbonyl ("NVOC") and the like. Representative hydroxyl protecting groups include, but are not limited to, those where the hydroxyl group is either acylated (e.g., methyl and ethyl esters, acetate or propionate groups or glycol esters) or alkylated such as benzyl and trityl ethers, as well as alkyl ethers, tetrahydropyranyl ethers, trialkylsilyl ethers (e.g., TMS or TIPPS groups) and allyl ethers. Other protecting groups can be found in the references noted herein.

"Leaving group" generally refers to any atom or moiety that is capable of being displaced by another atom or moiety in a chemical reaction. More specifically, a leaving group refers to an atom or moiety that is readily displaced and substituted by a nucleophile (e.g., an amine, a thiol, an alcohol, or cyanide). Such leaving groups are well known and include carboxylates, N-hydroxysuccinimide ("NHS"), N-hydroxybenzotriazole, a halogen (fluorine, chlorine, bromine, or iodine), and alkyloxy groups. Non-limiting characteristics and examples of leaving groups can be found, for example in *Organic Chemistry*, 2d ed., Francis Carey (1992), pages 328-331; *Introduction to Organic Chemistry*, 2d ed., Andrew Streitwieser and Clayton Heathcock (1981), pages 169-171; and *Organic Chemistry*, 5th Ed., John McMurry, Brooks/Cole Publishing (2000), pages 398 and 408; all of which are incorporated herein by reference.

"Suitable reaction conditions" refers to those conditions in the biocatalytic reaction solution (e.g., ranges of enzyme loading, substrate loading, cofactor loading, temperature, pH, buffers, co-solvents, etc.) under which a transaminase polypeptide of the present disclosure capable of converting a substrate to the desired amino product compound, e.g., converting compound (2) to compound (1). Exemplary "suitable reaction conditions" are provided in the present disclosure and illustrated by the Examples.

"Loading", such as in "compound loading" or "enzyme loading" refers to the concentration or amount of a component in a reaction mixture at the start of the reaction.

"Substrate" in the context of a biocatalyst mediated process refers to the compound or molecule acted on by the biocatalyst.

"Product" in the context of a biocatalyst mediated process refers to the compound or molecule resulting from the action of the biocatalyst. For example, an exemplary product for the transaminase biocatalyst in the processes disclosed herein is compound (1).

"Wet organic solvent" is defined as an organic solvent that includes up to the maximum amount of water that can be dissolved in that organic solvent. For example, the solubility of water in IPAc is acknowledged by those skilled in the art to be about 1.9 wt %, and wet IPAc containing up to about 1.9 wt % can be generated as described in the Examples, below, or by other suitable methods. Wet organic solvents, as used in this application, create minimal aqueous conditions without the addition of any water to a chemical reaction, such as the screening assay reactions described in the Examples.

"Minimal aqueous conditions" are those conditions created by use of wet organic solvents, without the addition of extra water. Minimal aqueous conditions use an organic solvent, containing up to the maximum amount of water that can be dissolved in that organic solvent, as the reaction condition or solvent system. As compared to aqueous conditions, minimal aqueous conditions do not include reaction conditions or solvent systems where water is added to the reaction or solvent system. Rather, the minimal aqueous conditions are created by first dissolving up to the maximum amount of water that can be dissolved in an organic solvent, next removing any undissolved water, and then using the wet organic solvent in a solvent system that does not include any additional water that is not dissolved in the wet organic solvent.

DETAILED DESCRIPTION OF THE INVENTION

The present invention provides engineered transaminase polypeptides and compositions thereof, as well as polynucleotides encoding the engineered transaminase polypeptides. Methods for producing transaminase enzymes are also provided. In some embodiments, the engineered transaminase polypeptides are optimized to provide improved enzyme properties under minimal aqueous conditions in wet organic solvents.

The transamination of a methyl keto ester substrate (methyl 4-methyl-3-oxo-pentanoate) to the corresponding S-homovaline ester product (methyl (S)-3-amino-4-methyl-pentanoate) is depicted in Scheme 2.

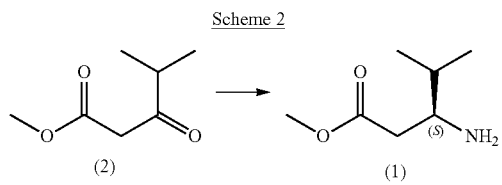

Product yields under typical aqueous conditions are limited by spontaneous hydrolysis of the amino ester product and spontaneous hydrolysis of the keto ester followed by decomposition. See Scheme 4, below.

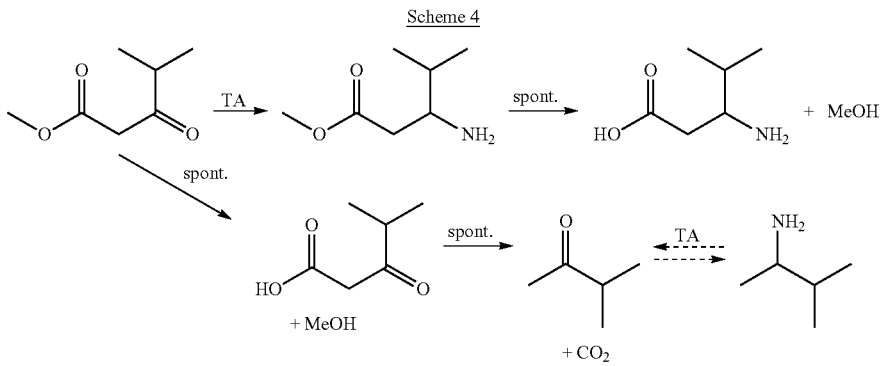

One approach to overcome the limitations of asymmetric enzymatic synthesis for industrial processes is use of wet organic solvents. However, this approach has been limited due to the lack of enzymes that demonstrate activity in organic solvents. Recently, preliminary work demonstrated activity of ω-transaminases from *Arthrobacter* species in wet organic solvents without the need for immobilization (Mutti & Kroutil, *Adv. Synth. Catal.*, 2012, 354, 3409-4313).

The polypeptides of the current invention have been engineered for high enantioselectivity and to be catalytically active under minimal aqueous conditions in wet organic solvents. This allows for the direct conversion of the methyl keto ester to the S-homovaline ester in wet organic solvent, which greatly minimizes spontaneous hydrolysis of both the methyl keto ester and the S-homovaline ester. Additionally, the engineered polypeptides of the current invention have been engineered to have increased thermoactivity, allowing reactions at elevated temperatures in the presence of wet organic solvents.

Engineered transaminases with improved activity in wet organic solvents and improved activity at elevated temperatures in wet organic solvents can be used in industrial processes for preparing chiral amines compounds in an optically active form.

Engineered Polypeptides Having Transaminase Activity

The present invention provides engineered transaminase polypeptides and compositions thereof, as well as polynucleotides encoding the engineered transaminase polypeptides. Methods for producing transaminase enzymes are also provided. In some embodiments, the engineered transaminase polypeptides are optimized to provide improved enzyme properties under minimal aqueous conditions in wet organic solvents.

The engineered polypeptides of the disclosure are non-naturally occurring transaminases engineered to have improved enzyme properties (such as increased stereoselectivity) as compared to the wild-type transaminase polypeptide of *Arthrobacter* sp. KNK168 (GenBank Acc. No. BAK39753.1, GI:336088341), and also as compared to the reference engineered transaminase polypeptide of SEQ ID NO:2, which was used as the starting backbone sequence for the directed evolution of the engineered polypeptides of the present disclosure. The reference engineered transaminase polypeptide of SEQ ID NO:2 has the following 30 amino acid differences relative to the wild-type *Arthrobacter* sp.

KNK168 polypeptide sequence: S8P, E42G, S54P, Y60F, L61Y, H62T, V65A, V69T, D81G, M94I, I96L, F122M, S124T, S126T, G136F, Y150F, V152S, Q155L, W156Q, A169L, V199I, A209L, G217N, S223P, L269P, L273Y, T282S, A284G, P297S, and S321P.

The engineered transaminase polypeptides of the present disclosure were generated by directed evolution of SEQ ID NO:2 for efficient conversion of compound (2) to compound (1) under certain industrially relevant conditions and have one or more residue differences as compared to the reference engineered transaminase polypeptide of SEQ ID NO:2. These residue differences are associated with improvements in various enzyme properties, particularly increased activity, increased stereoselectivity, increased stability, and tolerance of increased substrate and/or product concentration (e.g., decreased product inhibition) under minimal aqueous conditions in wet organic solvents. Accordingly, in some embodiments, the engineered polypeptides having transaminase activity are capable of converting the substrate compound (2) to compound (1) with an activity that is increased at least about 1 to 2 fold, 1.5 to 2.5 fold, 2 to 3 fold, 2.5 to 3.5 fold, 3 to 4 fold, 3.5 to 4.5 fold, 4 to 5 fold, 4.5 to 5 fold, 5 to 10 fold, 10 to 15 fold, or more relative to the activity of the reference polypeptide of SEQ ID NO:2, 6, 332, 518 and/or 656, under suitable reaction conditions. In some embodiments, the engineered polypeptides having transaminase activity are capable of converting the substrate of compound (2) to compound (1) with a percent conversion of at least about 1%, at least about 2%, at least about 3%, at least about 10%, at least about 15%, or at least about 20%, at least about 25%, at least about 30%, at least about 35%, at least about 40%, in a reaction time of about 72 h, about 48 h, about 36 h, about 24 h, about 20 h, or even a shorter length of time, under suitable reaction conditions. In some embodiments, the engineered polypeptides having transaminase activity are capable of converting compound (2) to compound (1) in enantiomeric excess of at least 90%, 95%, 97%, 98%, 99%, or greater, under suitable reaction conditions.

The suitable reaction conditions under which the above-described improved properties of the engineered polypeptides can be determined with respect to concentrations or amounts of polypeptide, substrate, amino group donor, cofactor, and/or conditions including temperature and reaction time. In some embodiments, the suitable reaction conditions include minimal aqueous conditions in a wet organic solvent. In some embodiments, the suitable reaction conditions comprise the HTP or SFP assay conditions described below and in the Examples.

In some embodiments, additional reaction components or additional techniques are utilized to supplement the reaction conditions. In some embodiments, these include taking measures to stabilize or prevent inactivation of the enzyme, reduce product inhibition, or shift reaction equilibrium to desired product formation.

In some further embodiments, any of the above described processes for the conversion of substrate compound to product compound can further comprise one or more steps selected from: extraction, isolation, purification, crystallization, filtration, and/or lyophilization of product compound(s). Methods, techniques, and protocols for extracting, isolating, purifying, and/or crystallizing the product(s) from biocatalytic reaction mixtures produced by the processes provided herein are known to the ordinary artisan and/or accessed through routine experimentation. Additionally, illustrative methods are provided in the Examples below.

Structure and function information for exemplary non-naturally occurring, engineered transaminase polypeptides of the present disclosure are shown above in Tables 1, 2, 3, 4, 5, 6, 7, and 8. The odd numbered sequence identifiers (i.e., SEQ ID NO) refer to the nucleotide (nt) sequence encoding the amino acid (aa) sequence provided by the even numbered SEQ ID NOs, and the sequences are provided in the electronic sequence listing file accompanying this disclosure, which are hereby incorporated by reference herein. The amino acid residue differences are based on comparison to the reference polypeptide sequence of SEQ ID NO:2, 6, 332, 518 and/or 656. The activity of each engineered polypeptide was determined using a high-throughput (HTP) assay (as a primary screen), and, in some cases, a secondary shake-flask powder (SFP) assay. Further details of the HTP and SFP preparations and assays are described in the Examples.

As will be apparent to the skilled artisan, the foregoing residue positions and the specific amino acid residues for each residue position can be used individually or in various combinations to synthesize transaminase polypeptides having desired improved properties, including, among others, enzyme activity, substrate/product preference, stereoselectivity, substrate/product tolerance, and stability under various conditions, such as minimal aqueous conditions in wet organic solvents.

In light of the guidance provided herein, it is further contemplated that any of the exemplary engineered polypeptides having the even-numbered sequence identifiers of SEQ ID NO:4-846 can be used as the starting amino acid sequence for synthesizing other engineered transaminase polypeptides, for example by subsequent rounds of evolution by adding in new combinations of various amino acid differences from other polypeptides in Tables 1, 2, 3, 4, 5, 6, 7, and 8, and other residue positions described herein. Further improvements may be generated by including amino acid differences at positions that had been maintained as unchanged throughout earlier rounds of evolution.

In some embodiments, the present disclosure also provides engineered transaminase polypeptides that comprise a fragment of any of the engineered transaminase polypeptides described herein that retains the functional transaminase activity and/or improved property of that engineered transaminase polypeptide. Accordingly, in some embodiments, the present disclosure provides a polypeptide fragment having transaminase activity (e.g., capable of converting compound (2) to compound (1) under suitable reaction conditions), wherein the fragment comprises at least about 80%, 90%, 95%, 98%, or 99% of a full-length amino acid sequence of an engineered polypeptide of the present disclosure, such as an exemplary engineered polypeptide of having the even-numbered sequence identifiers of SEQ ID NO:4-846.

In some embodiments, the engineered transaminase polypeptide of the disclosure can have an amino acid sequence comprising a deletion as compared to any one of the engineered transaminase polypeptide sequences described herein, such as the exemplary engineered polypeptide sequences having the even-numbered sequence identifiers of SEQ ID NO:4-846. Thus, for each and every embodiment of the engineered transaminase polypeptides of the disclosure, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 20% of the total number of amino acids, or up to 30% of the total number of amino acids of the transaminase polypeptides, where the associated functional activity and/or improved properties of the engineered transaminase described herein is maintained. In some embodiments, the deletions can comprise, 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, 1-50, 1-55, or 1-60 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 55, or 60 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, 25 or 30 amino acid residues.

In some embodiments, the present disclosure provides an engineered transaminase polypeptide having an amino acid sequence comprising an insertion as compared to any one of the engineered transaminase polypeptide sequences described herein, such as the exemplary engineered polypeptide sequences having the even-numbered sequence identifiers of SEQ ID NO:4-846. Thus, for each and every embodiment of the transaminase polypeptides of the disclosure, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, where the associated functional activity and/or improved properties of the engineered transaminase described herein is maintained. The insertions can be to amino or carboxy terminus, or internal portions of the transaminase polypeptide.

In some embodiments, the present disclosure provides a engineered polypeptides having transaminase activity, which comprise an amino acid sequence having at least 80%, 85%, 86%, 87%, 88%, 89%, 90%, 91%, 92%, 93%, 94%, 95%, 96%, 97%, 98%, or 99% identity to the sequences having the even-numbered sequence identifiers of SEQ ID NO:4-846, with the proviso that the amino acid sequence is not identical to (that is, it excludes) any of the exemplary engineered transaminase polypeptides amino acid sequences disclosed in U.S. Pat. No. 8,293,507 B2, issued Oct. 23, 2012, PCT Publication WO2011005477A1, published Jan. 13, 2011, PCT publication WO2012024104, published Feb. 23, 2012, and PCT Appl. No. PCT/US12/54300, filed Sep. 7, 2012, each of which is hereby incorporated by reference herein.

In the above embodiments, the suitable reaction conditions for the engineered polypeptides are those described in Tables 1, 2, 3, 4, 5, 6, 7, and 8. Accordingly, in some embodiments, the preparation of compounds of Formula (I) or compound (1) can be carried out wherein the suitable reaction conditions comprise: (a) substrate loading of about 10 to 220 g/L of substrate compound (e.g., compound (2)); (b) of about 0.5 g/L to 25 g/L engineered polypeptide; (c) IPM concentration of about 0.1 to 3 M; (d) a wet organic solvent; and (e) temperature of about 30° C. to 60° C. In some embodiments, the suitable reaction conditions comprise: (a) about 20 g/L of substrate compound (e.g., compound (2)); (b) about 20 g/L engineered polypeptide; (c) wet IPAc; (d) about 0.55 M IPM; and (e) about 50° C. Guidance for use of these reaction conditions and the transaminase polypeptides are provided in, among others, Tables 1, 2, 3, 4, 5, 6, 7, and 8, and the Examples.

In some embodiments, the polypeptides of the disclosure can be in the form of fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

The engineered transaminase polypeptides described herein are not restricted to the genetically encoded amino acids. Thus, in addition to the genetically encoded amino acids, the polypeptides described herein may be comprised, either in whole or in part, of naturally-occurring and/or synthetic non-encoded amino acids. Certain commonly encountered non-encoded amino acids of which the polypeptides described herein may be comprised include, but are not limited to: the D-stereoisomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-me thylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutamic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aOly); propargylglycine (pgGly); homoalanine (hAla); norvaline (nVal); homoleucine (hLeu), homovaline (hVal); homoisoleucine (hue); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (see, e.g., the various amino acids provided in Fasman, 1989, *CRC Practical Handbook of Biochemistry and Molecular Biology*, CRC Press, Boca Raton, FL, at pp. 3-70 and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg (tos), Cys (methylbenzyl), Cys (nitropyridinesulfenyl), Glu (δ-benzylester), Gln (xanthyl), Asn (N-δ-xanthyl), His (bom), His (benzyl), His (tos), Lys (fmoc), Lys (tos), Ser (O-benzyl), Thr (O-benzyl) and Tyr (O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having transaminase activity are bound or immobilized on the solid support such that they retain their improved activity, enantioselectivity, stereoselectivity, and/or other improved properties relative to the reference polypeptide of SEQ ID NO:2. In such embodiments, the immobilized polypeptides can facilitate the biocatalytic conversion of the substrate compound of Formula (II) or compound (2) to a corresponding amine product compound of Formula (I) or compound (1) and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the engineered transaminase polypeptides of the present disclosure can be carried out using the same transaminase polypeptides bound or immobilized on a solid support.

The engineered transaminase polypeptide can be bound non-covalently or covalently. Various methods for conjugation and immobilization of enzymes to solid supports (e.g., resins, membranes, beads, glass, etc.) are well known in the art. In particular, PCT publication WO2012/177527 A1 immobilized engineered transaminase polypeptides capable of converting compound (2) to compound (1) (including the reference polypeptide of SEQ ID NO:2), and methods of preparing the immobilized polypeptides, in which the polypeptide is physically attached to a resin by either hydrophobic interactions or covalent bonds, and is stable in a solvent system that comprises at least up to 100% organic solvent. Other methods for conjugation and immobilization of enzymes to solid supports (e.g., resins, membranes, beads, glass, etc.) are well known in the art and described in e.g., Yi et al., "Covalent immobilization of ω-transaminase from *Vibrio fluvialis* JS17 on chitosan beads," *Process Biochemistry* 42(5): 895-898 (May 2007); Martin et al., "Characterization of free and immobilized (S)-aminotransferase for acetophenone production," *Applied Microbiology and Biotechnology* 76(4): 843-851 (September 2007); Koszelewski et al., "Immobilization of ω-transaminases by encapsulation in a sol-gel/celite matrix," *Journal of Molecular Catalysis B: Enzymatic,* 63:39-44 (April 2010); Truppo et al., "Development of an Improved Immobilized CAL-B for the Enzymatic Resolution of a Key Intermediate to Odanacatib," *Organic Process Research & Development,* published online: dx.doi.org/10.1021/op200157c; Hermanson, G. T., Bioconjugate Techniques, Second Edition, Academic Press (2008); Mateo et al., "Epoxy sepabeads: a novel epoxy support for stabilization of industrial enzymes via very intense multipoint covalent attachment," *Biotechnology Progress* 18(3): 629-34 (2002); and Bioconjugation Protocols: Strategies and Methods, *In Methods in Molecular Biology*, C. M. Niemeyer ed., Humana Press (2004); the disclosures of each which are incorporated by reference herein.

Solid supports useful for immobilizing the engineered transaminase polypeptides of the present disclosure include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered transaminases of the present disclosure include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the engineered transaminase polypeptides can be provided in the form of an array in which the polypeptides are arranged in positionally distinct locations. In some embodiments, the positionally distinct locations are wells in a solid support such as a 96-well plate. A plurality of supports can be configured on an array at various locations, addressable for robotic delivery of reagents, or by detection methods and/or instruments. Such arrays can be used to test a variety of substrate compounds for conversion by the polypeptides.

In some embodiments, the engineered polypeptides described herein can be provided in the form of kits. The polypeptides in the kits may be present individually or as a plurality of polypeptides. The kits can further include reagents for carrying out enzymatic reactions, substrates for assessing the activity of polypeptides, as well as reagents for detecting the products. The kits can also include reagent dispensers and instructions for use of the kits. In some embodiments, the kits of the present disclosure include arrays comprising a plurality of different engineered transaminase polypeptides at different addressable position, wherein the different polypeptides are different variants of a reference sequence each having at least one different improved enzyme property. Such arrays comprising a plurality of engineered polypeptides and methods of their use are known (See e.g., WO2009/008908A2).

Polynucleotides, Control Sequences, Expression Vectors, and Host Cells Useful for Preparing Engineered Transaminase Polypeptides In another aspect, the present disclosure provides polynucleotides encoding the engineered polypeptides having transaminase activity described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered transaminase can be introduced into appropriate host cells to express the corresponding engineered transaminase polypeptide.

As will be apparent to the skilled artisan, availability of a protein sequence and the knowledge of the codons corresponding to the various amino acids provide a description of all the polynucleotides capable of encoding the subject protein sequence. The degeneracy of the genetic code, where the same amino acids are encoded by alternative or synonymous codons allows an extremely large number of nucleic acids to be made, all of which encode the improved transaminase enzymes disclosed herein. Thus, having identified a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made by selecting combinations based on the possible codon choices, and all such variations are to be considered specifically disclosed for any polypeptide disclosed herein, including the amino acid sequences of the exemplary engineered polypeptides provided in Tables 1, 2, 3, 4, 5, 6, 7, and 8, and disclosed in the sequence listing incorporated by reference herein as the sequences of the even-numbered sequence identifiers of SEQ ID NO:4-846.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. In some embodiments, all codons need not be replaced to optimize the codon usage of the transaminases since the natural sequence will comprise preferred codons and because use of preferred codons may not be required for all amino acid residues. Consequently, codon optimized polynucleotides encoding the transaminase enzymes may contain preferred codons at about 40%, 50%, 60%, 70%, 80%, or greater than 90% of codon positions of the full length coding region.

In some embodiments, the polynucleotide encodes a transaminase polypeptide comprising an amino acid sequence that is at least about 80%, 85%, 86%, 87%, 88%, 89%, 90%, 91%, 92%, 93%, 94%, 95%, 96%, 97%, 98%, 99%, or more identical to a reference sequence selected from the even-numbered sequence identifiers of SEQ ID NO:4-846, where the polypeptide has transaminase activity and one or more of the improved properties as described herein, for example the ability to convert compound (2) to product compound (1) with increased activity compared to the polypeptide of SEQ ID NO:2. In some embodiments, the reference sequence is selected from SEQ ID NO:6, 332, 518, and 656.

In some embodiments, the polynucleotide encoding the engineered transaminase polypeptide comprises a sequence selected from the odd-numbered sequence identifiers of SEQ ID NO:3-845. In some embodiments, the polynucleotide sequences are selected from SEQ ID NO:5, 331, 517, and 655.

In some embodiments, the polynucleotides are capable of hybridizing under highly stringent conditions to a reference polynucleotide sequence selected from any polynucleotide sequence provided herein, or a complement thereof, or a polynucleotide sequence encoding any of the variant enzyme polypeptides provided herein. In some embodiments, the polynucleotide capable of hybridizing under highly stringent conditions encodes an enzyme polypeptide comprising an amino acid sequence that has one or more residue differences as compared to a reference sequence.

In some embodiments, the polynucleotides encode the polypeptides described herein but have about 50%, 55%, 60%, 65%, 70%, 75%, 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered transaminase polypeptide. In some embodiments, the reference polynucleotide sequence is selected from the sequences having the odd-numbered sequence identifiers of SEQ ID NO:3-845.

In some embodiments, an isolated polynucleotide encoding any of the engineered enzyme polypeptides herein is manipulated in a variety of ways to facilitate expression of the enzyme polypeptide. In some embodiments, the polynucleotides encoding the enzyme polypeptides comprise expression vectors where one or more control sequences is present to regulate the expression of the enzyme polynucleotides and/or polypeptides. Manipulation of the isolated polynucleotide prior to its insertion into a vector may be desirable or necessary depending on the expression vector utilized. Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators. In some embodiments, suitable promoters are selected based on the host cell selection. For bacterial host cells, suitable promoters for directing transcription of the nucleic acid constructs of the present disclosure, include, but are not limited to promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., *Proc. Natl Acad. Sci.* USA 75: 3727-3731 [1978]), as well as the tac promoter (See e.g., DeBoer et al., *Proc. Natl Acad. Sci.* USA 80: 21-25 [1983]). Exemplary promoters for filamentous fungal host cells, include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., *Yeast* 8:423-488 [1992]).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the enzyme polypeptide. Any suitable terminator which is functional in the host cell of choice finds use in the present invention. Exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the enzyme polypeptide. Any suitable leader sequence that is functional in the host cell of choice finds use in the present invention. Exemplary leaders for filamentous fungal host cells are obtained from the genes for *Aspergillus oryzae* TAKA amylase, and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known (See e.g., Guo and Sherman, *Mol. Cell. Bio.*, 15:5983-5990 [1995]). Exemplary mammalian polyadenylation sequences can be found in Zhang et al., 2005, *Nucleic Acids Res.* 33:D116-D120.

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for Bacillus NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, *Microbiol. Rev.*, 57:109-137 [1993]). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region. In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention is directed to a recombinant expression vector comprising a polynucleotide encoding an engineered enzyme polypeptide, and one or more expression regulating regions such as a promoter and a terminator, a replication origin, etc., depending on the type of hosts into which they are to be introduced. In some embodiments, the various nucleic acid and control sequences described herein are joined together to produce recombinant expression vectors which include one or more convenient restriction sites to allow for insertion or substitution of the nucleic acid sequence encoding the enzyme polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the enzyme polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. orzyae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. orzyae*), sC (sulfate adenyltransferase), and trpC (anthranilate synthase), as well as equivalents thereof.

The expression vectors of the present disclosure also can include an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or non-homologous recombination.

Alternatively, the expression vector may contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements should preferably contain a sufficient number of nucleic acids, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori or the origins of replication of plasmids pBR322, pUC19, pACYC177 (which plasmid has the P15A ori), or pACYC184 permitting replication in *E. coli*, and pUB110, pE194, pTA1060, or pAMβ1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it function in a temperature-sensitive manner in the host cell (see, e.g., Ehrlich, 1978, *Proc Natl Acad Sci*. USA 75:1433).

More than one copy of a nucleic acid sequence of the present disclosure may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many expression vectors useful with the embodiments of the present disclosure are commercially available. Suitable commercial expression vectors include p3×FLAGTM™ expression vectors from Sigma-Aldrich Chemicals, which includes a CMV promoter and hGH polyadenylation site for expression in mammalian host cells and a pBR322 origin of replication and ampicillin resistance markers for amplification in *E. coli*. Other suitable expression vectors are pBluescriptII SK(−) and pBK-CMV, which are commercially available from Stratagene, LaJolla CA, and plasmids which are derived from pBR322 (Gibco BRL), pUC (Gibco BRL), pREP4, pCEP4 (Invitrogen) or pPoly (Lathe et al., 1987, Gene 57:193-201).

An exemplary expression vector can be prepared by operatively linking a polynucleotide encoding an improved transaminase into the plasmid pCK110900I which contains the lac promoter under control of the lacI repressor. The expression vector also contains the P15a origin of replication and the chloramphenicol resistance gene.

In another aspect, the present disclosure provides a host cell comprising a polynucleotide encoding an improved transaminase polypeptide of the present disclosure, the polynucleotide being operatively linked to one or more control sequences for expression of the transaminase enzyme in the host cell. Host cells for use in expressing the polypeptides encoded by the expression vectors of the present disclosure are well known in the art and include but are not limited to, bacterial cells, such as *E. coli, Arthrobacter* sp. KNK168, *Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. An exemplary host cell is *Escherichia* coli W3110 (ΔfhuA). Appropriate culture mediums and growth conditions for the above-described host cells are well known in the art.

Polynucleotides for expression of the transaminase may be introduced into cells by various methods known in the art. Techniques include among others, electroporation, biolistic particle bombardment, liposome mediated transfection, calcium chloride transfection, and protoplast fusion. Various methods for introducing polynucleotides into cells will be apparent to the skilled artisan.

Methods of Generating Engineered Transaminase Polypeptides

In some embodiments, to make the improved engineered polynucleotides and engineered polypeptides of the present disclosure, the naturally-occurring transaminase enzyme that catalyzes the transamination reaction is obtained (or derived) from *Arthrobacter* sp. KNK168. In some embodiments, the parent polynucleotide sequence is codon optimized to enhance expression of the transaminase in a specified host cell. The parental polynucleotide sequence encoding the wild-type polypeptide of *Arthrobacter* sp. KNK168 has been described (See e.g., Iwasaki et al., *Appl. Microbiol. Biotechnol.*, 2006, 69: 499-505). Preparations of engineered transaminases based on this parental sequence are also described in US patent publication no. 2010/0285541A1 and published International application WO2010/099501.

The engineered transaminases can be produced using any suitable methods known in the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related US, as well as PCT and non-US counterparts; Ling et al., *Anal. Biochem.*, 254(2):157-78 [1997]; Dale et al., *Meth. Mol. Biol.*, 57:369-74 [1996]; Smith, *Ann. Rev. Genet.*, 19:423-462 [1985]; Botstein et al., *Science*, 229:1193-1201 [1985]; Carter, *Biochem. J.*, 237:1-7 [1986]; Kramer et al., *Cell*, 38:879-887 [1984]; Wells et al., *Gene*, 34:315-323 [1985]; Minshull et al., *Curr. Op. Chem. Biol.*, 3:284-290 [1999]; Christians et al., *Nat. Biotechnol.*, 17:259-264 [1999]; Crameri et al., *Nature*, 391:288-291 [1998]; Crameri, et al., *Nat. Biotechnol.*, 15:436-438 [1997]; Zhang et al., *Proc. Nat. Acad. Sci.* U.S.A., 94:4504-4509 [1997]; Crameri et al., *Nat. Biotechnol.*, 14:315-319 [1996]; Stemmer, *Nature*, 370:389-391 [1994]; Stemmer, *Proc. Nat. Acad. Sci.* USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

The clones obtained following mutagenesis treatment can be screened for engineered transaminases having a desired improved enzyme property. Measuring enzyme activity from the expression libraries can be performed using the standard biochemistry techniques, such as HPLC analysis following OPA derivatization of the product amine.

Where the improved enzyme property desired is thermostability, enzyme activity may be measured after subjecting the enzyme preparations to a defined temperature and measuring the amount of enzyme activity remaining after heat treatments. Clones containing a polynucleotide encoding a transaminase are then isolated, sequenced to identify the nucleotide sequence changes (if any), and used to express the enzyme in a host cell.

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides of the disclosure can be prepared by chemical synthesis using, e.g., the classical phosphoramidite method described by Beaucage et al., 1981, *Tet Lett* 22:1859-69, or the method described by Matthes et al., 1984, *EMBO J.* 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be obtained from any of a variety of commercial sources.

In some embodiments, the present disclosure also provides methods for preparing or manufacturing the engineered transaminase polypeptides, wherein the methods comprise culturing a host cell capable of expressing a polynucleotide encoding the engineered polypeptide under culture conditions suitable for expression of the polypeptide.

In some embodiments, the method for preparation of the polypeptide further comprises isolating the polypeptide. The engineered polypeptides can be expressed in appropriate cells (as described above), and isolated (or recovered) from the host cells and/or the culture medium using any one or more of the well-known techniques used for protein purification, including, among others, lysozyme treatment, sonication, filtration, salting-out, ultra-centrifugation, and chromatography. Chromatographic techniques for isolation of the polypeptide include, among others, reverse phase chromatography high performance liquid chromatography, ion exchange chromatography, gel electrophoresis, and affinity chromatography. Conditions for purifying a particular engineered polypeptide will depend, in part, on factors such as net charge, hydrophobicity, hydrophilicity, molecular weight, molecular shape, etc., and will be apparent to those having skill in the art. The isolated polypeptide has to be lyophilized after purification.

Methods of Using the Engineered Transaminase Enzymes and Compounds Prepared Therewith In another aspect, the engineered transaminase polypeptides disclosed herein can be used in a process for the conversion of the substrate compound (2), or structural analogs thereof, to the product of compound (1) or the corresponding structural analog. Generally the structural analogs of compound (1) are encompassed within structural Formula (I).

In some embodiments, the present disclosure provides a process for preparing a compound of structural Formula (I):

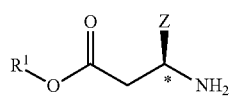

(I)

having the indicated stereochemical configuration at the stereogenic center marked with an *; in an enantiomeric excess of at least 70% over the opposite enantiomer, wherein Z is a linear $C_{1-6}$ alkyl or a branched $C_{1-6}$ alkyl, optionally substituted with one or more hydroxy, cyano, or nitro groups; and $R^1$ is $C_{1-6}$ alkyl, aryl-$C_{1-2}$ alkyl, heteroaryl-$C_{1-2}$ alkyl, or a 5- to 6-membered heterocyclic ring system optionally containing an additional heteroatom selected from O, S, and N, the heterocyclic ring being unsubstituted or substituted with one to three substituents independently selected from oxo, hydroxy, halogen, $C_{1-4}$ alkoxy, and $C_{1-4}$ alkyl; the process comprising the step of contacting a prochiral keto ester of structural Formula (II):

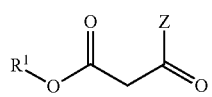

(II)

with an engineered polypeptide as disclosed herein in the presence of an amino group donor in a suitable organic solvent under suitable reaction conditions.

In some embodiments, the present disclosure provides a process of preparing compound (1);

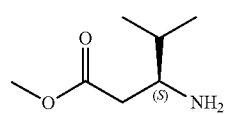

(1)

the process comprising a step of contacting a substrate of compound (2)

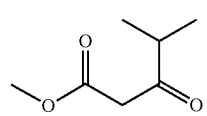

(2)

with an engineered polypeptide as disclosed herein in the presence of an amino group donor under suitable reaction conditions.

In some embodiments of the process for preparing a compound of structural Formula (I), the compound of Formula (II) specifically excludes compound (2) and the compound of Formula (I) prepared by the method specifically excludes compound (1).

As described herein, and illustrated in the Examples, the present disclosure contemplates ranges of suitable reaction conditions that can be used in the processes herein, including but not limited to ranges of temperature, wet organic solvent system, substrate loading, mixture of substrate compound stereoisomers, polypeptide loading, cofactor loading, and reaction time. Further suitable reaction conditions for carrying out the process for biocatalytic conversion of substrate compounds to product compounds using an engineered transaminase polypeptide described herein can be readily optimized by routine experimentation that includes, but is not limited to, contacting the engineered transaminase polypeptide and substrate compound under experimental reaction conditions of concentration temperature, wet organic solvent conditions, and detecting the product compound, for example, using the methods described in the Examples provided herein.

As described above, the engineered polypeptides having transaminase activity for use in the processes of the present disclosure generally comprise an amino acid sequence having at least 80%, 85%, 86%, 87%, 88%, 89%, 90%, 91%, 92%, 93%, 94%, 95%, 96%, 97%, 98%, or 99% identity to a reference amino acid sequence selected from any one of the even-numbered sequences of SEQ ID NO:4-846, and an engineered transaminase polypeptide comprising an amino acid sequence that has (a) has one or more amino acid residue differences as compared to SEQ ID NO:2. In some embodiments, the polynucleotide capable of hybridizing under highly stringent conditions encodes a transaminase polypeptide that has the percent identity described above and one or more residue differences as compared to SEQ ID NO:2.

Substrate compound in the reaction mixtures can be varied, taking into consideration, for example, the desired amount of product compound, the effect of substrate concentration on enzyme activity, stability of enzyme under reaction conditions, and the percent conversion of substrate to product. In some embodiments of the method, the suitable reaction conditions comprise a substrate compound loading of at least about 0.5 to about 200 g/L, 1 to about 200 g/L, 5 to about 150 g/L, about 10 to about 100 g/L, or about 50 to about 100 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of compound (2), however it also contemplated that the equivalent molar amounts of various hydrates and salts of compound (2) also can be used in the process. In addition, substrate compounds covered by Formula (II) can also be used in appropriate amounts, in light of the amounts used for compound (2).

In the processes described herein, the engineered transaminase polypeptide uses an amino donor to form the product compounds. In some embodiments, the amino donor in the reaction condition comprises a compound selected from IPM, putrescine, L-lysine, α-phenethylamine, D-alanine, L-alanine, D,L-alanine, D,L-ornithine, 3-aminobutyric acid, or methylbenzylamine. In some embodiments, the amino donor is selected from the group consisting of isopropylamine, alanine, 3-aminobutyric acid, or methylbenzylamine. In some embodiments, the amino donor is IPM. In some embodiments, the suitable reaction conditions comprise the amino donor, in particular IPM, present at a concentration of at least about 0.1 to about 3.0 M, 0.2 to about 2.5 M, about 0.5 to about 2 M or about 1 to about 2 M. In some embodiments, the amino donor is present at a concentration of about 0.1, 0.2, 0.3, 0.4, 0.5, 0.6, 0.7, 0.8, 1, 1.5, 2, 2.5 or 3 M.

Suitable reaction conditions for the processes also typically comprise the presence of a cofactor. Because the engineered transaminases typically use members of the vitamin $B_6$ family, the reaction condition can comprise a cofactor selected from-pyridoxal-5'-phosphate (also known as pyridoxal-phosphate, PLP, P5P), pyridoxine (PN), pyridoxal (PL), pyridoxamine (PM), and their phosphorylated counterparts; pyridoxine phosphate (PNP), and pyridoxamine phosphate (PMP). In some embodiments, the suitable reaction conditions can comprise the presence of a cofactor selected from PLP, PN, PL, PM, PNP, and PMP, at a concentration of about 0.1 g/L to about 10 g/L, about 0.2 g/L to about 5 g/L, about 0.5 g/L to about 2.5 g/L. In some embodiments, the cofactor is PLP. Accordingly, in some embodiments, the suitable reaction conditions can comprise the presence of the cofactor, PLP, at a concentration of about 0.1 g/L to about 10 g/L, about 0.2 g/L to about 5 g/L, about 0.5 g/L to about 2.5 g/L. In some embodiments, the reaction conditions comprise a PLP concentration of about 10 g/L or less, about 5 g/L or less, about 2.5 g/L or less, about 1.0 g/L or less, about 0.5 g/L or less, or about 0.2 g/L or less. In some embodiments, the cofactor is added to the cell lysate rather than the reaction mixture. In some embodiments, the cofactor is added to the cell lysate prior to lyophilization. In some embodiments, the cofactor, PLP, is added to the cell lysate at a concentration of about 0.1 g/L to about 10 g/L, about 0.2 g/L to about 5 g/L, about 0.5 g/L to about 2.5 g/L prior to lyophilization.

In some embodiments of the process (e.g., where whole cells or lysates are used), the cofactor is present naturally in the cell extract and does not need to be supplemented. In some embodiments of the process (e.g., using partially purified, or purified transaminase enzyme), the process can further comprise a step of adding cofactor to the enzyme reaction mixture. In some embodiments, the cofactor is added either at the beginning of the reaction and/or additional cofactor is added during the reaction.

In some embodiments, the reaction mixture comprises a wet organic solvent. Accordingly, in some embodiments, the pH of the reaction mixture is not monitored or maintained. In some embodiments, the wet organic solvent is wet IPAc, wet toluene, wet MTBE, wet MeCN, or wet IPA.

In the embodiments of the processes herein, a suitable temperature can be used for the reaction conditions, for example, taking into consideration the increase in reaction rate at higher temperatures, the activity of the enzyme for sufficient duration of the reaction, and as further described herein, the use of minimal aqueous conditions in wet organic solvents. For example, the engineered polypeptides of the present disclosure have increased thermoactivity in wet organic solvents relative to naturally occurring transaminase polypeptide, and the engineered polypeptide of SEQ ID NO:2, which allow the engineered polypeptides of the present disclosure to be used at higher temperatures for increased conversion rates. Accordingly, in some embodiments, the suitable reaction conditions comprise a temperature of about 10° C. to about 70° C., about 10° C. to about 65° C., about 15° C. to about 60° C., about 20° C. to about 60° C., about 20° C. to about 55° C., about 30° C. to about 55° C., or about 40° C. to about 50° C. In some embodiments, the suitable reaction conditions comprise a temperature of about 10° C., 15° C., 20° C., 25° C., 30° C., 35° C., 40° C., 45° C., 50° C., 55° C., 60° C., 65° C., or 70° C. In some embodiments, the temperature during the enzymatic reaction can be maintained at a temperature throughout the course of the reaction. In some embodiments, the temperature during the enzymatic reaction can be adjusted over a temperature profile during the course of the reaction.

In some embodiments of the process, the processes using the engineered transaminase polypeptides are conducted in a wet organic solvent with no aqueous component. In some embodiments of the process, the wet organic solvent is prepared by mixing 200 mL of water with 800 mL of dry wet organic solvent on top, then mixed with a magnetic stir bar overnight and allowed to separate before taking from the organic layer.

The suitable reaction conditions can comprise a combination of reaction parameters that provide for the biocatalytic conversion of the substrate compounds to its corresponding product compounds. Accordingly, in some embodiments of the process, the combination of reaction parameters comprises: (a) substrate loading of about 10 to 220 g/L of substrate compound (e.g., compound (2)); (b) of about 0.5 g/L to 25 g/L engineered polypeptide; (c) IPM concentration of about 0.1 to 3 M; (d) a wet organic solvent; and (e) temperature of about 30° C. to 60° C.

In some embodiments, the combination of reaction parameters comprises: (a) about 20 g/L of substrate compound (e.g., compound (2)); (b) about 20 g/L engineered polypeptide; (c) wet IPAc; (d) about 0.55 M IPM; and (e) about 50° C.

Further exemplary reaction conditions include the assay conditions provided in Tables 1, 2, 3, 4, 5, 6, 7, and 8, and in the Examples.

In carrying out the transamination reactions described herein, the engineered transaminase polypeptide may be added to the reaction mixture in the partially purified or purified enzyme, whole cells transformed with gene(s) encoding the enzyme, and/or as cell extracts and/or lysates of such cells. Whole cells transformed with gene(s) encoding the engineered transaminase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (e.g., ammonium sulfate, polyethyleneimine, heat treatment or the like), followed by a desalting procedure (e.g., ultrafiltration, dialysis, and the like) prior to lyophilization. Any of the enzyme preparations may be stabilized by crosslinking using known crosslinking agents, such as, for example, glutaraldehyde, or immobilized to a solid phase material (e.g., resins, beads such as chitosan, Eupergit C, SEPABEADs, and the like).

In some embodiments of the transamination reactions described herein, the reaction is carried out under the suitable reaction conditions described herein, wherein the engineered transaminase polypeptide is immobilized to a solid support. Solid supports useful for immobilizing the engineered transaminases for carrying out the transamination reactions include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, solid reactants (e.g., enzyme, salts, etc.) may be provided to the reaction in a variety of different forms, including powder (e.g., lyophilized, spray dried, and the like). The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

In some embodiments, it is also contemplated that the process comprising the biocatalytic conversion of amine acceptor substrate compounds to chiral amine product compounds using transaminase polypeptides of the present disclosure can further comprise steps of formation of pharmaceutically acceptable salts or acids, pharmaceutically acceptable formulations, product work-up, extraction, isolation, purification, and/or crystallization, each of which can be carried out under a range of conditions.

In some embodiments, the processes using the engineered polypeptides disclosed herein can be carried out wherein the process further comprises the step of isolating the compound of Formula (I) or the compound (1) from the reaction.

In some embodiments, the processes using the engineered polypeptides disclosed herein can be carried out wherein the amino group donor is selected from IPM, alanine, 3-aminobutyric acid, or methylbenzylamine. In some embodiments, the amino group donor is IPM.

Methods, techniques, and protocols for extracting, isolating, forming a salt of, purifying, and/or crystallizing aminated product compounds or cyclized compounds from biocatalytic reaction mixtures produced by the above disclosed processes are known to the ordinary artisan and/or accessed through routine experimentation. Additionally, illustrative methods are provided in the Examples below.

Various features and embodiments of the disclosure are illustrated in the following representative examples, which are intended to be illustrative, and not limiting.

EXAMPLES

Example 1

E. coli Expression Hosts Containing Recombinant Transaminase Genes

A codon-optimized and engineered transaminase gene (SEQ ID NO:1) encoding the reference engineered polypeptide of SEQ ID NO:2 was used as the starting backbone for directed evolution to generate the genes encoding the engineered polypeptides having transaminase activity of the even numbered sequence identifiers of SEQ ID NO:4-846, each of which is capable of converting the substrate compound (2) to the product compound (1) with improved enzyme properties relative to it and/or the reference polypeptide of SEQ ID NO:2. The gene of SEQ ID NO:1 and polypeptide of SEQ ID NO:2 of the present disclosure correspond to SEQ ID NO:129 and 130 of U.S. Pat. No. 9,617,573 B2. The engineered transaminase polypeptide of SEQ ID NO:2 has the following 30 amino acid differences relative to the wild-type Arthrobacter sp. KNK168 polypeptide sequence (GenBank accession: BAK39753.1; GI:336088341): S8P, E42G, S54P, Y60F, L61Y, H62T, V65A, V69T, D81G, M94I, I96L, F122M, S124T, S126T, G136F, Y150F, V152S, Q155L, W156Q, A169L, V199I, A209L, G217N, S223P, L269P, L273Y, T282S, A284G, P297S, and S321P. Cloning of SEQ ID NO:1 in the pCK110900 vector system (See e.g., US Patent Application Publication 2006/0195947A1) and subsequent expression in E. coli W3110fhuA was as described in U.S. Pat. No. 8,293,507 B2. Briefly, the E. coli W3110 expresses the transaminase polypeptides as an intracellular protein under the control of the lac promoter. The polypeptide accumulates primarily as a soluble cytosolic, active enzyme. Standard methods of directed evolution via iterative variant library generation by gene synthesis followed by screening and sequencing of hits to generate the engineered derivatives of the gene sequence SEQ ID NO:1 disclosed herein.

Example 2

Preparation of HTP Transaminase Containing Wet Cell Pellets

E. coli cells containing recombinant transaminase encoding genes from monoclonal colonies were inoculated into 180 μl Luria Broth (LB) containing 1% glucose and 30 μg/mL chloramphenicol (CAM) in the wells of 96-well shallow well microtiter plates. The plates were sealed with $O_2$-permeable seals and cultures were grown overnight at 30° C., 200 rpm and 85% humidity. Then, 10 μl of each of the cell cultures were transferred into the wells of 96-well deep well plates containing 390 μl Terrific Broth (TB) and 30 μg/mL CAM. The deep-well plates were sealed with $O_2$-permeable seals and incubated at 30° C., 250 rpm and 85% humidity until $OD_{600}$ 0.6-0.8 was reached. The cell cultures were then induced by isopropyl β-D-1-thiogalactopyranoside (IPTG) to a final concentration of 1 mM and incubated overnight under the same conditions as originally used. The plates were centrifuged at 4,000 rpm for 10 minutes, the supernatants discarded and pellets frozen at −80° C. before lysis as described in Example 3. Alternatively the cells from two identical plates were pooled using wide bore tips and pelleted using centrifugation at 4000 rpm for 10 minutes. The supernatants were discarded and the double pellets frozen at −80° C. prior to lysis as described in Example 5.

Example 3

Preparation of HTP Transaminase-Containing Cell Lysates

First, 200 μl lysis buffer containing 100 mM triethanolamine buffer, pH 7.5, 0.25 mg/mL lysozyme, 0.2 mg/mL polymyxin b sulfate (PMBS), and 100 uM pyrodoxal-5-phosphate (PLP) was added to the cell paste in each well produced as described in Example 2. The cells were lysed at room temperature for 2 hours with shaking on a bench top shaker. The plate was then centrifuged for 10 minutes at 4,000 rpm and 4° C. The clear supernatants were then used in biocatalytic reactions to determine their stereoselectivity as described in Example 4.

Example 4

Improvements Over SEQ ID NO:2 in Stereoselectivity

SEQ ID NO:2 was selected as the parent enzyme. Libraries of engineered genes were produced using well-established techniques (e.g., saturation mutagenesis, and recombination of previously identified beneficial mutations). The polypeptides encoded by each gene were produced in HTP as described in Example 2, and the soluble lysate was generated as described in Example 3. Each reaction well contained 80 μL of HTP lysate prepared as explained in Example 3 and the following final conditions in a 200 uL volume per well: 20 g/L substrate compound (2), DMSO 40 vol %, 0.2M borate with 1.5M IPM 50 vol % and 1 g/L PLP; the pH was adjusted to pH=8.5. The plates were heat sealed and shaken at 60° C. overnight (18-22 hours). The reactions were quenched by adding 200 uL per well of acetonitrile. The plates were heat sealed and shaken for 15 minutes at 1,000 rpm and then centrifuged at 4,000 rpm for 10 minutes. 200 uL per well of cleared supernatant were transferred to a filter plate. The filter plate was placed on top of a 96-well round bottom Costar plate and centrifuged for 5 minutes at 4,000 rpm. The 96-well round bottom Costar plate was heat sealed and analyzed using Chiral LC-MS (Method 3, Example 10).

Stereoselectivity is calculated as % enantiomeric excess (% ee): desired (S) product peak area−undesired (R) product peak area/desired (S) product peak area+undesired (R) product peak area*100.

TABLE 1

| HTP Stereoselectivity | | |
| --- | --- | --- |
| SEQ ID NO: (nt/aa) | Amino Acid Differences (compared to SEQ ID NO: 2) | % ee |
| 1/2 | None | 12 |
| 3/4 | G284A; | 97 |
| 5/6 | G284A; L155W | 99 |

Example 5

Preparation of Lyophilized HTP Lysates From Transaminase Containing Wet Cell Lysates HTP lysis and lyophilization of HTP lysates: Three conditions for HTP lysis of transaminase containing wet cell pellets (generated as double pellets, as described in Example 2) and lyophilization of generated HTP lysates were used: A, B, and C.

Condition A: First, 300 μl lysis buffer, containing 0.25 mg/mL (1 mg/mL Condition B and C) lysozyme; 0.2 mg/mL (0.5 mg/mL Condition B and C) PMBS; in 100 mM (25 mM Condition B and C) triethanolamine buffer pH 7.5; 10 μl of 2,000 U/mL endonuclease per plate, was added to the double pellet cell paste in each well produced as described in Example 2. The cells were lysed at room temperature for 2 hours with shaking on a bench top shaker. The plates were then centrifuged for 20 minutes at 4,000 rpm and 4° C. 220 μl (150 μl Condition C) of clarified lysate was transferred into 96-well glass coated deep well plates. In preliminary experiments, glass-coated deep well and polypropylene plates warped under certain reaction conditions. Therefore, glass plates or vials were necessary for Condition B and C (Freeslate/Chemglass glass vial plates). The plates were covered with airpore seal and placed in −80° C., with direct contact of 96-well samples with freezer shelf for 2 hours. The plates were placed in the lyophilizer. The lyophilizer vacuum was brought down to 200 bar and the following program was run: pre-chill at −40° C., thermal treatment at −40° C. for 120 minutes, 100 mTorr; drying step: 10° C., 100 mTorr 1,000-1,200 minutes. The plates were removed from the lyophilizer and assayed almost immediately. For Condition B and C: The plates were frozen in the lyophilizer for ~2 hr at −40° C. with the frost seal set to on ~600-700 mTorr. The lyophilizer vacuum was brought to 200 mTorr and the following program run: Pre-Chill: −40° C.; thermal treatment: −40° C., 100 minutes, 100 mTorr; Drying Steps: 1. −40 to −15° C. (1° C./min), 100 mTorr; 2. −15° C., 600 minutes, 100 mTorr; 3. −15 to 0° C. (1° C./min), 100 mTorr, 0° C., 900 minutes, 100 mTorr (method complete after overnight and stopped after 1,000-1,200 minutes of Step 4).

Example 6

Preparation of Lyophilized Lysates From Shake Flask (SF) Cultures

Selected HTP cultures grown as described above were plated onto LB agar plates with 1% glucose and 30 μg/ml CAM and grown overnight at 37° C. A single colony from each culture was transferred to 6 ml of LB with 1% glucose and 30 μg/ml CAM. The cultures were grown for 18 hours at 30° C., 250 rpm, and subcultured approximately 1:50 into 250 ml of TB containing 30 μg/ml CAM, to a final $OD_{600}$ of 0.05. The cultures were grown for approximately 195 minutes at 30° C., 250 rpm, to an $OD_{600}$ between 0.6-0.8 and induced with 1 mM IPTG. The cultures were then grown for 20 hours at 30° C., 250 rpm. The cultures were centrifuged 4000 rpm for 20 minutes. The supernatant was discarded, and the pellets were resuspended in 30 ml of 25 mM triethanolamine pH 7.5 and lysed using a Microfluidizer system (Microfluidics) at 18,000 psi. The lysates were pelleted (10,000 rpm for 60 minutes) and the supernatants were frozen and lyophilized to generate shake flake (SF) enzymes.

Example 7

HTP Screening for Activity Improvements

HTP screening, conversion assay: Wet IPAc was prepared by mixing 200 mL of water with 800 mL of dry IPAc on top, which was mixed with a magnetic stir bar overnight and allowed to separate before taking from the organic layer. The ester substrate was premixed in wet IPAc with 4 equivalencies of IPM relative to substrate concentration. The final reaction parameters in the conversion HTP assay were: 20 g/L ester substrate (2), 4 equivalencies of IPM, and HTP lyophilized cake prepared as explained in Conditions A-C in Example 5. First, 200 μl/well of 20 g/L ester substrate and 4 equivalencies IPM in wet IPAc, were added to 96-well glass coated well plates. The glass coated plates were heat sealed and incubated at 30° C., 400 rpm for 24 hours. The reactions in 96-well glass coated plates were quenched by adding 1000 μl/well of dry IPAc. The plates were heat sealed, shaken for 1 minute and then centrifuged at 4° C. to 4,000 rpm for 5 minutes. The 6-fold IPAc diluted samples were transferred to 96-well Costar round bottom plates for GC-FID analysis. Alternatively 50 μl of 6-fold IPAc diluted samples were transferred into 950 μl of water in deep well plates. Then, 5 μl of 20-fold water diluted IPAc quenched reaction was added to 195 μl of water in 96-well Costar round bottom plates for RapidFire MS analysis.

| Key for Tables 2-8 | |
|---|---|
| Indicator | FIOPC |
| + | 1 to 2 |
| ++ | 2 to 3 |
| +++ | 3 to 4 |
| ++++ | 4 to 5 |
| +++++ | 5 to 10 |

TABLE 2

HTP Activity in Organic Solvent of HTP Lyophilized Powders Produced in Condition A, Example 5

| SEQ ID NO: (nt/aa) | Amino Acid Differences (compared to SEQ ID NO: 6) | Activity Fold-Improvement[1] |
|---|---|---|
| 5/6 | None | / |
| 7/8 | E9H; | + |
| 9/10 | H71Y;Q102P; | + |
| 11/12 | I140N;D266N; | + |
| 13/14 | I55S; | + |
| 15/16 | N32S; | + |
| 17/18 | E104S; | + |
| 19/20 | Q146A; | + |
| 21/22 | R119A; | + |
| 23/24 | I55G; | + |
| 25/26 | P145N; | + |
| 27/28 | E111L; | + |
| 29/30 | Y23Q; | + |
| 31/32 | E104I; | + |
| 33/34 | T16I; | + |
| 35/36 | R79H; | + |
| 37/38 | N90A; | + |
| 39/40 | S24P; | + |
| 41/42 | Y20H; | + |
| 43/44 | D29K; | + |
| 45/46 | S24F; | + |
| 47/48 | T134S; | + |
| 49/50 | I41Y; | + |
| 51/52 | Q146I; | + |
| 53/54 | P33M; | + |
| 55/56 | S89M; | + |
| 57/58 | P33L; | + |
| 59/60 | Y20T; | + |
| 61/62 | T134G; | + |
| 63/64 | I55F; | + |
| 65/66 | I55K; | +++ |
| 67/68 | K142T; | + |
| 69/70 | S93P; | + |
| 71/72 | W40M; | + |
| 73/74 | Q156E; | + |
| 75/76 | F160A; | + |
| 77/78 | D139A; | + |
| 79/80 | Q146L; | + |
| 81/82 | N32L; | + |
| 83/84 | N90C; | + |
| 85/86 | EMT; | + |
| 87/88 | D82P; | + |
| 89/90 | Q156T; | + |
| 91/92 | A114T; | + |
| 93/94 | V46C; | + |
| 95/96 | I41K; | + |
| 97/98 | S24D; | + |
| 99/100 | T101L; | + |
| 101/102 | F45L; | + |
| 103/104 | E50T; | + |
| 105/106 | N90T; | + |
| 107/108 | F160V; | + |
| 109/110 | A35G; | + |

TABLE 2-continued

HTP Activity in Organic Solvent of HTP
Lyophilized Powders Produced in Condition A, Example 5

| SEQ ID NO: (nt/aa) | Amino Acid Differences (compared to SEQ ID NO: 6) | Activity Fold-Improvement[1] |
|---|---|---|
| 111/112 | L18G; | + |
| 113/114 | F160Y; | + |
| 115/116 | Q146H; | + |
| 117/118 | T22W; | + |
| 119/120 | R95P; | + |
| 121/122 | A35G;E221D; | + |
| 123/124 | D15T; | + |
| 125/126 | E117D; | + |
| 127/128 | P98M; | + |
| 129/130 | T22H; | + |
| 131/132 | K106S; | + |
| 133/134 | S89W; | ++ |
| 135/136 | N90S; | + |
| 137/138 | Y23H; | + |
| 139/140 | S89L; | + |
| 141/142 | R95T; | + |
| 143/144 | D82T; | + |
| 145/146 | S93M; | + |
| 147/148 | S89Q; | + |
| 149/150 | Y26P; | + |
| 151/152 | F160L; | + |
| 153/154 | P33S; | + |
| 155/156 | S93H; | + |
| 157/158 | E9T; | + |
| 159/160 | T101S; | + |
| 161/162 | D15I; | + |
| 163/164 | D29M; | + |
| 165/166 | A5T;A35Y; | + |
| 167/168 | L18R; | + |
| 169/170 | L264N; | + |
| 171/172 | P244L; | ++++ |
| 173/174 | A262V; | + |
| 175/176 | L324C; | + |
| 177/178 | E271C; | + |
| 179/180 | A262T; | + |
| 181/182 | D266S; | + |
| 183/184 | R197T; | + |
| 185/186 | P244G; | + |
| 187/188 | G215L; | + |
| 189/190 | L218S; | + |
| 191/192 | K249M; | + |
| 193/194 | Y26H;Y273K; | + |
| 195/196 | H168P; | + |
| 197/198 | P244T; | + |
| 199/200 | E208L; | + |
| 201/202 | E208P; | + |
| 203/204 | A265R; | + |
| 205/206 | L218N;R313H; | + |
| 207/208 | P244L;Y273C; | ++ |
| 209/210 | Y273L; | + |
| 211/212 | V234H; | + |
| 213/214 | R197L; | + |
| 215/216 | E316R; | + |
| 217/218 | I246V; | + |
| 219/220 | R248M; | + |
| 221/222 | E320W; | + |
| 223/224 | P179R; | + |
| 225/226 | D216P; | + |
| 227/228 | P244E; | + |
| 229/230 | L264P; | + |
| 231/232 | E208R; | + |
| 233/234 | H203P; | + |
| 235/236 | A262L; | + |
| 237/238 | Q186R;Q200R; | + |
| 239/240 | K249T; | + |
| 241/242 | Q186R; | + |
| 243/244 | R248V; | + |
| 245/246 | G301M; | + |
| 247/248 | L264R; | ++ |
| 249/250 | D216S; | + |
| 251/252 | P321L; | + |
| 253/254 | F207Y; | + |
| 255/256 | G301E; | + |
| 257/258 | L264G; | + |

TABLE 2-continued

HTP Activity in Organic Solvent of HTP
Lyophilized Powders Produced in Condition A, Example 5

| SEQ ID NO: (nt/aa) | Amino Acid Differences (compared to SEQ ID NO: 6) | Activity Fold-Improvement[1] |
|---|---|---|
| 259/260 | Q329R; | + |
| 261/262 | R236T; | + |
| 263/264 | E320R; | + |
| 265/266 | Y273M; | + |
| 267/268 | L264W; | + |
| 269/270 | E256C; | + |
| 271/272 | L218R; | + |
| 273/274 | A262P; | + |
| 275/276 | I246A; | + |
| 277/278 | L264E; | + |
| 279/280 | D266G; | + |
| 281/282 | E208K; | + |
| 283/284 | D216G; | + |
| 285/286 | I246L; | + |
| 287/288 | L264A; | + |
| 289/290 | L324V; | + |
| 291/292 | L324W; | + |
| 293/294 | E9T;P244G;A262T;L264N; | ++ |
| 295/296 | E9T;P244G;K249G; | ++ |
| 297/298 | T134G;P244L; | +++ |
| 299/300 | E9T;Y23Q;S24F; | ++ |
| 301/302 | E9T;T101S;P244G; | +++ |
| 303/304 | E9T;Y23Q;S24F;T101S;A262V; | + |
| 305/306 | E9T;S24F;P244G;A262T; | ++ |
| 307/308 | E9T;Y23Q;D29M; | + |
| 309/310 | E9T;Y20T;Y23Q;T101S;P244L; | +++ |
| 311/312 | E9T;Y23Q;S24F;D29M;P244G; | + |
| 313/314 | R79G; | + |
| 315/316 | E9T;S24F;K249G; | + |
| 317/318 | E9T;S24F;P244G; | ++ |
| 319/320 | K249G; | + |
| 321/322 | E9T;Y23Q;S24F;P244L;A262T; | + |
| 323/324 | E9T;Y20T;S24F;T101S;P244G;K249G; | + |
| 325/326 | T134G;A262V; | ++ |
| 327/328 | Y20T;Y23Q;S24F;I55F;T134G;P244G;A262T; | ++++ |
| 329/330 | E9T;Y20T;Y23Q;S24F;T134S;P244G; | ++ |
| 331/332 | Y20T;Y23Q;T134S;P244G; | +++ |
| 333/334 | E9T;R79G;T101S;P244G; | ++ |
| 335/336 | E9T;A262T; | + |
| 337/338 | Q156L; | + |
| 339/340 | N74A; | + |
| 341/342 | P321V; | + |
| 343/344 | D15I;S24P;Y26P;S89M;S93M;F160L; | + |
| 345/346 | Y20H;P33L;F160L; | + |
| 347/348 | S89M;S93M;Q156L;L324C; | ++ |
| 349/350 | D15I;T16I;L18R;Y20H;S89M;S93M;F160L; | + |
| 351/352 | S89M;S93M;P321V;L324C; | + |
| 353/354 | S93M;L324C; | ++ |
| 355/356 | Y20H;L324C; | + |
| 357/358 | Y20H;S24P;S89M;R197T; | ++ |
| 359/360 | D82S;P244D; | + |
| 361/362 | E9H;I246L; | ++ |
| 363/364 | E9H;S89Q;E271C; | + |
| 365/366 | Q146A;P244D; | + |
| 367/368 | E9H;S89Q;I246L; | ++ |
| 369/370 | E9H;D82S;S89Q; | ++ |
| 371/372 | E9H;L110V;V302F; | + |
| 373/374 | E9H;F45L;S89Q;S93H; | ++ |
| 375/376 | D29K;S89Q; | + |
| 377/378 | E9H;S93H;K142M;I246L; | + |
| 379/380 | G17I;D25R;F160V; | + |
| 381/382 | G17I;D25R; | + |
| 383/384 | Y23H;D25R;I55L;P321Y; | + |
| 385/386 | D25R; | + |
| 387/388 | K142L;P321Y; | + |
| 389/390 | G17I;D25R;I41F; | + |
| 391/392 | G42T; | + |
| 393/394 | D25R;E104V; | + |
| 395/396 | T22L; | + |
| 397/398 | T22L;F160V; | + |
| 399/400 | Q102L; | + |
| 401/402 | Y23H;D25R;Q102L;K142L; | + |
| 403/404 | F56R; | + |
| 405/406 | Y23H;Q102L; | ++ |

TABLE 2-continued

HTP Activity in Organic Solvent of HTP
Lyophilized Powders Produced in Condition A, Example 5

| SEQ ID NO: (nt/aa) | Amino Acid Differences (compared to SEQ ID NO: 6) | Activity Fold-Improvement[1] |
|---|---|---|
| 407/408 | D25R;P321Y; | + |
| 409/410 | D25R;F160V; | ++ |
| 411/412 | Y23H;P321Y; | + |
| 413/414 | D25R;P33M; | + |
| 415/416 | I41F;Q102L; | + |
| 417/418 | P321Y; | + |
| 419/420 | T22L;Q102L; | + |
| 421/422 | G17I;F160V; | + |
| 423/424 | L18G;Y273T; | + |
| 425/426 | L18K;H168P;P244L; | + |
| 427/428 | E208L;I246V; | + |
| 429/430 | L18G;Q146L;A262V; | + |
| 431/432 | P244G;R248M;A284G; | ++ |
| 433/434 | L18K;P244G;I246V; | + |
| 435/436 | W40M;P244G;R248M; | + |
| 437/438 | L18K;Q146L;H168P; | + |
| 439/440 | L18G;Y273V; | ++ |
| 441/442 | L18G;P244G;R248M; | + |
| 443/444 | L18K;P244G;I246V;A284G; | ++ |
| 445/446 | A284G; | ++ |
| 447/448 | L18K;H168P;A262V;L324W; | + |
| 449/450 | Y273V; | ++ |
| 451/452 | L18K; | + |
| 453/454 | L18K;P244T;A262V;Y273T; | ++ |
| 455/456 | L18G;Y26H;I246V;Y273T; | ++ |
| 457/458 | Y273T; | ++ |
| 459/460 | L18K;Y273T; | ++ |
| 461/462 | L18G;H168P; | ++ |
| 463/464 | L18K;A262V; | ++ |
| 465/466 | P244G;R248M; | ++ |
| 467/468 | L18K;P244L;I246V; | ++ |
| 469/470 | L18G;P244L;Y273V; | + |
| 471/472 | L18G;Q146L; | + |
| 473/474 | L18K;P244L; | ++ |
| 475/476 | P244L;Y273V; | ++ |
| 477/478 | L18K;Q146L; | ++ |
| 479/480 | L18G;P244G; | ++ |
| 481/482 | Q146L;P244L; | + |
| 483/484 | Q146L;Y273V; | ++ |
| 485/486 | L18K;H168P; | ++ |
| 487/488 | W40M;H168P;E208L;P244G; | + |
| 489/490 | D216P;Y273V; | +++ |
| 491/492 | I246V;R248M;Y273V; | ++ |
| 493/494 | H168P;P244L;Y273T; | ++ |
| 495/496 | A35G;G215L;L218R;K249T; | + |
| 497/498 | F160Y;G215L;D216G;L218R; | + |
| 499/500 | T101L;F160Y;P244E;K249M; | + |
| 501/502 | D15T;L218R;Y273K; | + |
| 503/504 | L218R;K249M; | + |
| 505/506 | G215L;D216G;K249M; | + |
| 507/508 | K249M;Y273K; | + |
| 509/510 | A35G;L218R;K249T;Y273K; | ++ |
| 511/512 | D15T;K249M;Y273K; | + |
| 513/514 | D15T;A35G;Y273K; | + |
| 515/516 | F160Y;Y273K; | + |

[1]Activity Fold-Improvement was calculated as the ratio of the product compound (1) produced by the specified engineered polypeptide under the activity assay reaction conditions (noted in Example 7) per the product produced, under the same reaction conditions by the engineered polypeptide of SEQ ID NO: 6. Amount of product produced was determined by GC-FID or RapidFire-MS analysis of the quenched assay samples prepared as noted in Example 10.

TABLE 3

HTP Activity in Organic Solvent of HTP
Lyophilized Powders Produced in Condition A, Example 5

| SEQ ID NO: (nt/aa) | Amino Acid Differences (compared to SEQ ID NO: 332) | Activity Fold-Improvement[1] |
|---|---|---|
| 331/332 | None | / |
| 517/518 | E9H;S89Q;F160Y; | + |
| 519/520 | S89M;S93M;F160V;K249M; | + |
| 521/522 | E9H;S89M;S93M;T101S;F160Y; | + |
| 523/524 | A35M; | + |
| 525/526 | L317W; | + |
| 527/528 | T141A; | + |
| 529/530 | K142N; | + |

TABLE 3-continued

HTP Activity in Organic Solvent of HTP Lyophilized Powders Produced in Condition A, Example 5

| SEQ ID NO: (nt/aa) | Amino Acid Differences (compared to SEQ ID NO: 332) | Activity Fold-Improvement[1] |
|---|---|---|
| 531/532 | I140M; | + |
| 533/534 | P321A; | + |
| 535/536 | E107R; | + |
| 537/538 | S323R; | + |
| 539/540 | S297T; | + |
| 541/542 | H168R; | + |
| 543/544 | N296V; | + |
| 545/546 | S292T; | + |
| 547/548 | I140S; | + |
| 549/550 | P327S; | + |
| 551/552 | P321S; | + |
| 553/554 | V302Q; | + |
| 555/556 | A270S; | + |
| 557/558 | R144A; | + |
| 559/560 | P327Q; | + |
| 561/562 | T141H; | + |
| 563/564 | V302L; | + |
| 565/566 | P327H; | + |
| 567/568 | Q156T; | + |
| 569/570 | S323V; | + |
| 571/572 | N74K; | + |
| 573/574 | Q156C; | + |
| 575/576 | Y273L; | + |
| 577/578 | P321T; | + |
| 579/580 | Q329R; | + |
| 581/582 | D300T; | + |
| 583/584 | I140L; | + |
| 585/586 | N74R; | + |
| 587/588 | S89L; | + |
| 589/590 | E117D; | + |
| 591/592 | F207G; | + |
| 593/594 | Q329V; | + |
| 595/596 | H168P; | + |
| 597/598 | D274G; | + |
| 599/600 | S49P; | + |
| 601/602 | S297L; | + |
| 603/604 | S89W; | + |
| 605/606 | V234T; | + |
| 607/608 | N296W; | + |
| 609/610 | V234I; | + |
| 611/612 | P305T; | + |
| 613/614 | E107V; | + |
| 615/616 | P33N; | + |
| 617/618 | P305Q; | + |
| 619/620 | K142A; | + |
| 621/622 | D274A; | + |
| 623/624 | V319T; | + |
| 625/626 | S89V; | + |
| 627/628 | E107M; | + |
| 629/630 | N296M; | + |
| 631/632 | H203L; | + |
| 633/634 | A44T; | + |
| 635/636 | A270R; | + |
| 637/638 | I108L; | + |
| 639/640 | A35H; | + |
| 641/642 | V302I; | + |

[1]Activity Fold-Improvement was calculated as the ratio of the product compound (1) produced by the specified engineered polypeptide under the activity assay reaction conditions (noted in Example 7) per the product produced, under the same reaction conditions by the engineered polypeptide of SEQ ID NO: 332. Amount of product produced was determined by GC-FID or RapidFire-MS analysis of the quenched assay samples prepared as noted in Example 10.

TABLE 4

HTP Activity in Organic Solvent of HTP Lyophilized Powders Produced in Condition B, Example 5

| SEQ ID NO: (nt/aa) | Amino Acid Differences (compared to SEQ ID NO: 518) | Activity Fold-Improvement[1] |
|---|---|---|
| 517/518 | None | / |
| 643/644 | V46L;Y273L; | + |
| 645/646 | Y273L; | + |
| 647/648 | P159D; | + |
| 649/650 | E111Q;P159D;Y273L; | + |
| 651/652 | P159D;Y273L; | + |
| 653/654 | A35H;Y273L; | + |
| 655/656 | I199L; | + |
| 657/658 | S174G; | + |
| 659/660 | V287P; | + |

[1]Activity Fold-Improvement was calculated as the ratio of the product compound (1) produced by the specified engineered polypeptide under the activity assay reaction conditions (noted in Example 7) per the product produced, under the same reaction conditions by the engineered polypeptide of SEQ ID NO: 518. Amount of product produced was determined by GC-FID or RapidFire-MS analysis of the quenched assay samples prepared as noted in Example 10.

Example 8

HTP Screening for Thermoactivity Improvements

HTP screening, thermoactivity assay: Wet IPAc was prepared by mixing 200 mL of water with 800 mL of dry IPAc on top, which was mixed with a magnetic stir bar overnight and allowed to separate before taking from the organic layer. The ester substrate was premixed in wet IPAc with 4 equivalencies of IPM relative to substrate concentration. The final reaction parameters in the conversion HTP assay were: 20 g/L ester substrate (2), 4 equivalencies of IPM, and HTP lyophilized cake prepared as explained in Conditions A-C in Example 5. First, 200 µl/well of 20 g/L ester substrate and 4 equivalencies IPM in wet IPAc, were added to Freeslate glass vial plates. The Freeslate glass vial plates were evenly torqued down with screws and incubated at 50° C. at 400 rpm for 24 hours. The reactions in Freeslate 96 glass vial plates were quenched by adding 400 µl/well of dry IPAc. Next, 100 µl/well were transferred from Freeslate 96 glass vial plates into 96-well Costar plates containing 100 µl/well of dry IPAc and submitted for GC-FID analysis.

TABLE 5

HTP Thermoactivity in Organic Solvent of HTP Lyophilized Powders Produced in Condition A, Example 5

| SEQ ID NO: (nt/aa) | Amino Acid Differences (compared to SEQ ID NO: 332) | Activity Fold-Improvement[1] |
|---|---|---|
| 331/332 | None | / |
| 543/544 | N296V; | + |
| 545/546 | S292T; | + |
| 553/554 | V302Q; | + |
| 555/556 | A270S; | + |
| 561/562 | T141H; | + |
| 563/564 | V302L; | + |
| 567/568 | Q156T; | + |
| 571/572 | N74K; | + |
| 579/580 | Q329R; | + |
| 583/584 | I140L; | + |
| 585/586 | N74R; | + |
| 593/594 | Q329V; | + |
| 621/622 | D274A; | + |
| 629/630 | N296M; | + |
| 637/638 | I108L; | + |
| 661/662 | F160Y; | + |
| 663/664 | Q23Y;D29Y;I55K; | + |
| 665/666 | V319R; | + |
| 667/668 | H168Q; | + |
| 669/670 | G215A; | + |

TABLE 5-continued

HTP Thermoactivity in Organic Solvent of HTP Lyophilized Powders Produced in Condition A, Example 5

| SEQ ID NO: (nt/aa) | Amino Acid Differences (compared to SEQ ID NO: 332) | Activity Fold-Improvement[1] |
|---|---|---|
| 671/672 | G215T; | + |
| 673/674 | A270Q; | + |
| 675/676 | S323L; | + |
| 677/678 | L34Y; | + |
| 679/680 | F160W; | + |
| 681/682 | R144V; | + |
| 683/684 | V302S; | + |
| 685/686 | E92D; | + |
| 687/688 | F160V; | + |
| 689/690 | A44N; | + |
| 691/692 | E117R; | + |
| 693/694 | E256G; | + |
| 695/696 | N296Y; | + |
| 697/698 | P269T; | + |
| 699/700 | G215S; | + |

[1]Activity Fold-Improvement was calculated as the ratio of the product compound (1) produced by the specified engineered polypeptide under the activity assay reaction conditions (noted in Example 8) per the product produced, under the same reaction conditions by the engineered polypeptide of SEQ ID NO: 332. Amount of product produced was determined by GC-FID analysis of the quenched assay samples prepared as noted in Example 10.

TABLE 6

HTP Thermoactivity in Organic Solvent of HTP Lyophilized Powders Produced in Condition B, Example 5

| SEQ ID NO: (nt/aa) | Amino Acid Differences (compared to SEQ ID NO: 518) | Activity Fold-Improvement[1] |
|---|---|---|
| 517/518 | None | / |
| 643/644 | V46L;Y273L; | + |
| 645/646 | Y273L; | + |
| 655/656 | I199L; | + |
| 701/702 | N74K;E92D; | + |
| 703/704 | Y160V;G215S;Q329R; | + |
| 705/706 | L34Y;N74K;E92D; | + |
| 707/708 | S292T; | + |
| 709/710 | A35H;Y273L;S323R; | + |
| 711/712 | A39G; | + |
| 713/714 | F207Y; | + |
| 715/716 | T126V; | + |
| 717/718 | P48G; | + |
| 719/720 | R138A; | + |
| 721/722 | T178S; | + |
| 723/724 | I55V; | + |
| 725/726 | F150W; | + |
| 727/728 | T126L; | + |
| 729/730 | S133T; | + |

[1]Activity Fold-Improvement was calculated as the ratio of the product compound (1) produced by the specified engineered polypeptide under the activity assay reaction conditions (noted in Example 8) per the product produced, under the same reaction conditions by the engineered polypeptide of SEQ ID NO: 518. Amount of product produced was determined by GC-FID analysis of the quenched assay samples prepared as noted in Example 10.

TABLE 7

HTP Thermoactivity in Organic Solvent of HTP Lyophilized Powders Produced in Condition C, Example 5

| SEQ ID NO: (nt/aa) | Amino Acid Differences (compared to SEQ ID NO: 656) | Activity Fold-Improvement[1] |
|---|---|---|
| 655/656 | None | / |
| 731/732 | A39G;F207Y;Y273L; | + |
| 733/734 | Y273L; | + |
| 735/736 | A39G;T178S;Y273L; | + |
| 737/738 | A39G;F150W;Y273L; | + |
| 739/740 | T126V;S133T;T178S; | + |
| 741/742 | R138A;F150W;T178S; | + |
| 743/744 | A39G;S133T;T178S;Y273L; | + |
| 745/746 | A39G;F150W;T178S;F207Y;Y273L; | + |
| 747/748 | A35H;F150W;Y273L; | + |
| 749/750 | F150W;F207Y;Y273L; | + |
| 751/752 | F150W;T178S;S323R; | + |
| 753/754 | F150W;Y273L; | + |
| 755/756 | F150W; | + |
| 757/758 | A35H;R138A;F150W;Y273L; | + |
| 759/760 | T126V;R138A;T178S; | + |
| 761/762 | I55V; | + |
| 763/764 | T126V;T178S;F207Y; | + |
| 765/766 | A35H;Y273L; | + |
| 767/768 | A35H;T178S;Y273L; | + |
| 769/770 | T178S;Y273L; | + |
| 771/772 | A39G;Y273L; | + |
| 773/774 | A39G;T178S; | + |
| 775/776 | A39G;F150W;T178S;F207Y; | + |
| 777/778 | I55V;F150W; | + |
| 779/780 | A35H;A39G;I55V;R138A;F150W; | + |
| 781/782 | T126V; | + |
| 783/784 | A35H;A39G;T126V;F150W;Y273L; | + |
| 785/786 | A35H;A39G;S133T;F150W;Y273L; | + |
| 787/788 | A35H;A39G;F150W; | + |
| 789/790 | A39G;F207Y; | + |
| 791/792 | A39G;I55V;F150W;Y273L; | ++ |
| 793/794 | A35H;A39G;F150W;Y273L; | + |
| 795/796 | A39G;S133T;F150W; | + |
| 797/798 | A39G; | + |
| 799/800 | F150W;T178S;Y273L;S323R; | + |
| 801/802 | A35H;A39G;S133T; | + |
| 803/804 | A39G;T126V;F150W; | + |
| 805/806 | A35H;S133T;T178S; | + |
| 807/808 | A39G;I55V;F150W;T178S;Y273L; | ++ |
| 809/810 | A39G;F150W;T178S; | + |
| 811/812 | A35H;A39G;I55V;F150W; | + |
| 813/814 | A39G;S133T;Y273L; | + |
| 815/816 | A44Q; | + |
| 817/818 | P269V; | + |
| 819/820 | G239N; | + |
| 821/822 | F88W; | + |
| 823/824 | S132E; | + |
| 825/826 | R312A; | + |
| 827/828 | I55F; | + |
| 829/830 | I263E; | + |
| 831/832 | A44L; | + |
| 833/834 | S297E; | + |
| 835/836 | T141S; | + |
| 837/838 | H168D; | + |
| 839/840 | S132D; | + |
| 841/842 | E261R; | + |
| 843/844 | L18R; | + |
| 845/846 | S297R; | + |

[1]Activity Fold-Improvement was calculated as the ratio of the product compound (1) produced by the specified engineered polypeptide under the activity assay reaction conditions (noted in Example 8) per the product produced, under the same reaction conditions by the engineered polypeptide of SEQ ID NO: 656. Amount of product produced was determined by GC-FID analysis of the quenched assay samples prepared as noted in Example 10.

Example 9

Shake Flask Powder Testing

Wet IPAc (or MTBE or toluene) was prepared by mixing 200 mL of water with 800 mL of dry IPAc on top, which was mixed with a magnetic stir bar overnight and allowed to separate before taking from the organic layer. The ester substrate was premixed in wet IPAc (or MTBE or toluene) with 4 equivalencies of IPM relative to substrate concentration. The final reaction parameters were: 20 g/L ester substrate, 4 equivalencies of IPM, 20 mg of lyophilized shake flask powder prepared as explained in Example 6.

Next, 20 mg of lyophilized shake flask powder was weighed into a 4 mL glass vial. Then, 1 mL of reaction mix was added to the vial, and the vial sealed with a Teflon seal. The vials were incubated at 50° C. for 24 hours. The reactions were quenched by adding 2 mL of dry IPAc. Then, 500 µL of quenched reaction was diluted into 500 µL of dry IPAc in a GC glass vial. The vial was submitted for GC-FID analysis.

TABLE 8

Thermoactivity in Organic Solvent of Shake Flask Powders Produced as Described in Example 6

| SEQ ID NO: (nt/aa) | Amino Acid Differences (compared to SEQ ID NO: 2) | Activity Fold-Improvement in wet IPAc[1] | Activity Fold-Improvement in wet MTBE[2] | Activity Fold-Improvement in wet toluene[3] |
|---|---|---|---|---|
| 6/7 | L155W;G284A; | / | / | / |
| 331/332 | Y20T;Y23Q;T134S;L155W;P244G;G284A; | + | + | +++++ |
| 517/518 | E9H;Y20T;Y23Q;S89Q;T134S;L155W;F160Y;P244G;G284A; | + | + | +++++ |
| 655/656 | E9H;Y20T;Y23Q;S89Q;T134S;L155W;F160Y;I199L;P244G;G284A; | ++ | / | +++++ |
| 807/808 | E9H;Y20T;Y23Q;A39G;I55V;S89Q;T134S;F150W;L155W;F160Y;T178S;I199L;P244G;Y273L;G284A; | ++++ | / | +++++ |

[1] Activity Fold-Improvement in wet IPAc was calculated as the ratio of the product compound (1) produced by the specified engineered polypeptide under the activity assay reaction conditions (noted in Example 9) per the product produced, under the same reaction conditions by the engineered polypeptide of SEQ ID NO: 6. Amount of product produced was determined by GC-FID analysis of the quenched assay samples prepared as noted in Example 10.
[2] Activity Fold-Improvement in wet MTBE was calculated as the ratio of the product compound (1) produced by the specified engineered polypeptide under the activity assay reaction conditions (noted in Example 9) per the product produced, under the same reaction conditions by the engineered polypeptide of SEQ ID NO: 6. Amount of product produced was determined by GC-FID analysis of the quenched assay samples prepared as noted in Example 10.
[3] Activity Fold-Improvement in wet toluene was calculated as the ratio of the product compound (1) produced by the specified engineered polypeptide under the activity assay reaction conditions (noted in Example 9) per the product produced, under the same reaction conditions by the engineered polypeptide of SEQ ID NO: 6. Amount of product produced was determined by GC-FID analysis of the quenched assay samples prepared as noted in Example 10.

Example 10

Analytical Methods

Method 1—Achiral GC-FID Method

The quenched reactions, prepared as explained in Examples 7, 8 and 9 were subject to GC-FID analysis under the following conditions:

| | |
|---|---|
| Instrument | Agilent Technologies 6890N Network GC system |
| Column | Rtx-5 amine 0.25 µm 30 m × 0.25 mm |
| Gas Flow rate | H$_2$; 110° C. for 2.22 min, ramp to 150° C. @ 18° C./min, then ramp to 200° C. @ 25° C./min, 4.82 min hold 200° C. for a total 4.82 min run. |
| Detection | FID: 300° C., 40 mL/min H$_2$; 400 mL air; make-up (Helium): 5 mL/min |
| Injector Temp. | 50° C injector |
| Injection Volume | 100:1 split; 0.2 µL injection; 12.2 psi |
| Runtime | 9 min |
| Peak identification details | 1.831 min Ester: 2.096 min Product (varies for each GC) |

Method 2—Achiral RapidFire-MS Method

The quenched reactions, prepared as explained in Example 7 were subject to RapidFire-MS analysis under the following conditions

| Agilent RapidFire conditions | |
|---|---|
| Pump1 Buffer | MS grade water; 1.5 mL/min flow rate |
| Pump2 Buffer | 90% MS grade acetonitrile 10% water; 1.25 mL/min flow rate |
| Pump3 Buffer | 90% MS grade acetonitrile 10% water; 1.25 mL/min flow rate |
| Aqueous wash | Water |
| Organic wash | Acetonitrile |
| SPE cartridge | D, hypercarb |
| RF state 1 Aspirate | 600 ms |
| RF state 2 Load/Wash | 3000 ms |
| RF state 3 Extra Wash | 0 |
| RF state 4 Elute | 4000 ms |
| RF state 5 Reequilibrate | 2000 ms |

| Agilent Jet Stream source parameters | |
|---|---|
| Diying gas temperature | 300° C. |
| Drying gas flow | 10 L/min |
| Nebulizer pressure | 45 psi |
| Sheath gas temperature | 350° C. |
| Sheath gas flow | 11 L/min |
| Capillary voltage | 2500 V |
| Nozzle voltage | 1000 V |

| Agilent 6470 Triple Quadrupole MRM parameters | | | | | | |
|---|---|---|---|---|---|---|
| Compound | Q1 | Q3 | Dwell | Fragmentor | CE | CAV |
| Amino ester product | 146 | 128.9 | 60 | 70 | 5 | 3 |
| Amino ester product | 146 | 72 | 60 | 70 | 10 | 3 |
| Amino ester product | 146 | 55 | 60 | 70 | 29 | 3 |
| Amino acid product | 132 | 72 | 60 | 70 | 10 | 3 |
| Amino acid product | 137 | 55.1 | 60 | 70 | 27 | 3 |

Method 3—Chiral LC-MS Method

The quenched reactions, prepared as explained in Example 4 were subject to Chiral LC-MS analysis under the following conditions:

| | |
|---|---|
| Instrument | Agilent 1290-Single Quad MS |
| Column | Zwix (-) 3 µm 4 × 150 mm |
| Mobile Phase | A: 49:49:2, ACN:MeoH:water, 30 mM ammonium formate (1.89 g/L), 25 mM formic acid (950 µL/L) |

| | |
|---|---|
| Flow rate | 1.2 mL/min |
| Detection | UV = 220 nm (Resp Time = 40 Hz) MS2 ESI |
| MS Conditions | MODE: ESI (pos) Drying Gas = 12 L/min; Nebulizer Press = 35 psi; Drying Gas T = 350 C; CAP v (pos) = 3000; SIM mode 132.2 and 146.2; Frag = 70 v |
| Column Temp. | 45° C. |
| Injection Volume | 1 uL |
| Runtime | 6 min |
| Peak identification details | MS-Selected Ion Monitoring @ 132.2 and 146.4 m/z: 1.70 min Ester: 3.40 min R Product, 3.90 min S product |

SEQUENCE LISTING (846 sequences)

SEQ ID NO: 1 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 2 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 3 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtacctgcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 4 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYLQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 5 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 6 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 7 - DNA, 990 bp, Artificial Sequence
  Variants of transaminase from Arthrobacter sp
atggcgttctcagcggacacccctcatatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 8 - protein, 330 aa, Artificial Sequence
  Variants of transaminase from Arthrobacter sp
MAFSADTPHIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 9 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttctacgtttggaacggtaacgctttccgtctgggggaccacatcgaacgtctgttctctaatgcggaatctattcgtttgatcccgccgctgaccccggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 10 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFYVWNGNAFRLGDHIERLFSNAESIRLIPPLTPDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 11 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacaataccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctaacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 12 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDNTKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILANITPAELYDADEVLGCSTAGGVWPFVSVDGNSISDGVPGPVTQSIIRRYWELNVEPSSLLTPVQY

SEQ ID NO: 13 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgagtttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 14 - protein, 330 aa, Artificial Sequence
  Variants of transaminase from Arthrobacter sp
MAFSADTPEIVYTHDTGLDYITYSDYELDPANPLAGGAAWIGGAFVPPSEARIPSFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 15 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggcttcgccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 16 - protein, 330 aa, Artificial Sequence
  Variants of transaminase from Arthrobacter sp
MAFSADTPEIVYTHDTGLDYITYSDYELDPASPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 17 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggactctgttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 18 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDSVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 19 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccggctgtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 20 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPAVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 21 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactggctgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 22 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELAEAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 23 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccggggttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 24 - protein, 330 aa, Artificial Sequence
  Variants of transaminase from Arthrobacter sp
MAFSADTPEIVYTHDTGLDYITYSDYELDPANPLAGGAAWIGGAFVPPSEARIPGFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 25 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtaatcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 26 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRNQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 27 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctgttgctggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 28 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALLLVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 29 - DNA, 990 bp, Artificial Sequence
  Variants of transaminase from Arthrobacter sp
atggcgttctcagcggacacccctgaaatcgtttacacccacgacaccggtctggactatatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 30 - protein, 330 aa, Artificial Sequence
  Variants of transaminase from Arthrobacter sp
MAFSADTPEIVYTHDTGLDYITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 31 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacattgttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 32 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDIVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 33 - DNA, 990 bp, Artificial Sequence
  Variants of transaminase from Arthrobacter sp
atggcgttctcagcggacacccctgaaatcgtttacacccacgacattggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 34 - protein, 330 aa, Artificial Sequence
  Variants of transaminase from Arthrobacter sp
MAFSADTPEIVYTHDIGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 35 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccatctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 36 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFHLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 37 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctgctgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 38 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSAAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 39 - DNA, 990 bp, Artificial Sequence
  Variants of transaminase from Arthrobacter sp
atggcgttctcagcggacacccctgaaatcgtttacacccacgacaccggtctggactatatcacctaccctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgtttgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 40 - protein, 330 aa, Artificial Sequence
  Variants of transaminase from Arthrobacter sp
MAFSADTPEIVYTHDTGLDYITYPDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 41 - DNA, 990 bp, Artificial Sequence
  Variants of transaminase from Arthrobacter sp
atggcgttctcagcggacacccctgaaatcgtttacacccacgacaccggtctggaccatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 42 - protein, 330 aa, Artificial Sequence
  Variants of transaminase from Arthrobacter sp
MAFSADTPEIVYTHDTGLDHITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 43 - DNA, 990 bp, Artificial Sequence
  Variants of transaminase from Arthrobacter sp
atggcgttctcagcggacacccctgaaatcgtttacacccacgacaccggtctggactatatcacctactctgactacgaactgaagccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 44 - protein, 330 aa, Artificial Sequence
  Variants of transaminase from Arthrobacter sp
MAFSADTPEIVYTHDTGLDYITYSDYELKPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 45 - DNA, 990 bp, Artificial Sequence
  Variants of transaminase from Arthrobacter sp
atggcgttctcagcggacacccctgaaatcgtttacacccacgacaccggtctggactatatcacctactttgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 46 - protein, 330 aa, Artificial Sequence
  Variants of transaminase from Arthrobacter sp
MAFSADTPEIVYTHDTGLDYITYFDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 47 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttctccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 48 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 49 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggtatggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 50 - protein, 330 aa, Artificial Sequence
  Variants of transaminase from Arthrobacter sp
MAFSADTPEIVYTHDTGLDYITYSDYELDPANPLAGGAAWYGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 51 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgattgtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 52 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPIVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 53 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacatgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 54 - protein, 330 aa, Artificial Sequence
  Variants of transaminase from Arthrobacter sp
MAFSADTPEIVYTHDTGLDYITYSDYELDPANMLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 55 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcatgaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 56 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFMNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 57 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacttgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 58 - protein, 330 aa, Artificial Sequence
  Variants of transaminase from Arthrobacter sp
MAFSADTPEIVYTHDTGLDYITYSDYELDPANLLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 59 - DNA, 990 bp, Artificial Sequence
  Variants of transaminase from Arthrobacter sp
atggcgttctcagcggacacccctgaaatcgtttacacccacgacaccggtctggacacgatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 60 - protein, 330 aa, Artificial Sequence
  Variants of transaminase from Arthrobacter sp
MAFSADTPEIVYTHDTGLDTITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 61 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctggtccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 62 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSGPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 63 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgtttttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 64 - protein, 330 aa, Artificial Sequence
  Variants of transaminase from Arthrobacter sp
MAFSADTPEIVYTHDTGLDYITYSDYELDPANPLAGGAAWIGGAFVPPSEARIPFFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 65 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgaagttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 66 - protein, 330 aa, Artificial Sequence
  Variants of transaminase from Arthrobacter sp
MAFSADTPEIVYTHDTGLDYITYSDYELDPANPLAGGAAWIGGAFVPPSEARIPKFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 67 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccactcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 68 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITTHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 69 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaaccgattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 70 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAEPIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 71 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgctatgattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 72 - protein, 330 aa, Artificial Sequence
  Variants of transaminase from Arthrobacter sp
MAFSADTPEIVYTHDTGLDYITYSDYELDPANPLAGGAAMIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 73 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactgggagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 74 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWEIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 75 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccggcggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 76 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPADRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 77 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgcgatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 78 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERAITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 79 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgctggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 80 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPLVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 81 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctcttccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 82 - protein, 330 aa, Artificial Sequence
  Variants of transaminase from Arthrobacter sp
MAFSADTPEIVYTHDTGLDYITYSDYELDPALPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 83 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctcttgtgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 84 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSCAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 85 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctgacgctggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 86 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALTLVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 87 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctggggccgcacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 88 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGPHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 89 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggacgatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 90 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWTIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 91 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttactaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 92 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVTKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 93 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttctgtccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 94 - protein, 330 aa, Artificial Sequence
  Variants of transaminase from Arthrobacter sp
MAFSADTPEIVYTHDTGLDYITYSDYELDPANPLAGGAAWIGGAFCPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 95 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggaagggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 96 - protein, 330 aa, Artificial Sequence
  Variants of transaminase from Arthrobacter sp
MAFSADTPEIVYTHDTGLDYITYSDYELDPANPLAGGAAWKGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 97 - DNA, 990 bp, Artificial Sequence
  Variants of transaminase from Arthrobacter sp
atggcgttctcagcggacacccctgaaatcgtttacacccacgacaccggtctggactatatcacctacgatgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 98 - protein, 330 aa, Artificial Sequence
  Variants of transaminase from Arthrobacter sp
MAFSADTPEIVYTHDTGLDYITYDDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 99 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgcttcaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 100 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLLQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 101 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttggttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 102 - protein, 330 aa, Artificial Sequence
  Variants of transaminase from Arthrobacter sp
MAFSADTPEIVYTHDTGLDYITYSDYELDPANPLAGGAAWIGGALVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 103 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcgacggctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 104 - protein, 330 aa, Artificial Sequence
  Variants of transaminase from Arthrobacter sp
MAFSADTPEIVYTHDTGLDYITYSDYELDPANPLAGGAAWIGGAFVPPSTARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 105 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctacggcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 106 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSTAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 107 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccggtggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 108 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPVDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 109 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctgggtggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 110 - protein, 330 aa, Artificial Sequence
  Variants of transaminase from Arthrobacter sp
MAFSADTPEIVYTHDTGLDYITYSDYELDPANPLGGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 111 - DNA, 990 bp, Artificial Sequence
  Variants of transaminase from Arthrobacter sp
atggcgttctcagcggacacccctgaaatcgtttacacccacgacaccggtggtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 112 - protein, 330 aa, Artificial Sequence
  Variants of transaminase from Arthrobacter sp
MAFSADTPEIVYTHDTGGDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 113 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtatgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 114 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 115 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcatgtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 116 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPHVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 117 - DNA, 990 bp, Artificial Sequence
  Variants of transaminase from Arthrobacter sp
atggcgttctcagcggacacccctgaaatcgtttacacccacgacaccggtctggactatatctggtactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 118 - protein, 330 aa, Artificial Sequence
  Variants of transaminase from Arthrobacter sp
MAFSADTPEIVYTHDTGLDYIWYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 119 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattccgttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 120 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIPLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 121 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggggggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgatggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 122 - protein, 330 aa, Artificial Sequence
  Variants of transaminase from Arthrobacter sp
MAFSADTPEIVYTHDTGLDYITYSDYELDPANPLGGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLADGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 123 - DNA, 990 bp, Artificial Sequence
  Variants of transaminase from Arthrobacter sp
atggcgttctcagcggacacccctgaaatcgtttacacccacactaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 124 - protein, 330 aa, Artificial Sequence
  Variants of transaminase from Arthrobacter sp
MAFSADTPEIVYTHTTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 125 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgatctgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 126 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTDLREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 127 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcatgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 128 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIMPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 129 - DNA, 990 bp, Artificial Sequence
  Variants of transaminase from Arthrobacter sp
atggcgttctcagcggacacccctgaaatcgtttacacccacgacaccggtctggactatatccattactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 130 - protein, 330 aa, Artificial Sequence
  Variants of transaminase from Arthrobacter sp
MAFSADTPEIVYTHDTGLDYIHYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 131 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagtttctgagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 132 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVSEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 133 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctggaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 134 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFWNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 135 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctcttcggcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 136 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSSAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 137 - DNA, 990 bp, Artificial Sequence
  Variants of transaminase from Arthrobacter sp
atggcgttctcagcggacacccctgaaatcgtttacacccacgacaccggtctggactatatcacccattctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 138 - protein, 330 aa, Artificial Sequence
  Variants of transaminase from Arthrobacter sp
MAFSADTPEIVYTHDTGLDYITHSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 139 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccttaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 140 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFLNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 141 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattacgttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 142 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESITLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 143 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctggggactcacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 144 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGTHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 145 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaaatgattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 146 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAEMIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 147 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccagaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 148 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 149 - DNA, 990 bp, Artificial Sequence
  Variants of transaminase from Arthrobacter sp
atggcgttctcagcggacacccctgaaatcgtttacacccacgacaccggtctggactatatcacctactctgaccctgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 150 - protein, 330 aa, Artificial Sequence
  Variants of transaminase from Arthrobacter sp
MAFSADTPEIVYTHDTGLDYITYSDPELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 151 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgctggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 152 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPLDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 153 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaactctctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 154 - protein, 330 aa, Artificial Sequence
  Variants of transaminase from Arthrobacter sp
MAFSADTPEIVYTHDTGLDYITYSDYELDPANSLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 155 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaacatattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 156 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAEHIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 157 - DNA, 990 bp, Artificial Sequence
  Variants of transaminase from Arthrobacter sp
atggcgttctcagcggacacccctactatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 158 - protein, 330 aa, Artificial Sequence
  Variants of transaminase from Arthrobacter sp
MAFSADTPTIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 159 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgtcgcaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 160 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLSQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 161 - DNA, 990 bp, Artificial Sequence
  Variants of transaminase from Arthrobacter sp
atggcgttctcagcggacacccctgaaatcgtttacacccacattaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 162 - protein, 330 aa, Artificial Sequence
  Variants of transaminase from Arthrobacter sp
MAFSADTPEIVYTHITGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 163 - DNA, 990 bp, Artificial Sequence
  Variants of transaminase from Arthrobacter sp
atggcgttctcagcggacacccctgaaatcgtttacacccacgacaccggtctggactatatcacctactctgactacgaactgatgccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 164 - protein, 330 aa, Artificial Sequence
  Variants of transaminase from Arthrobacter sp
MAFSADTPEIVYTHDTGLDYITYSDYELMPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 165 - DNA, 990 bp, Artificial Sequence
  Variants of transaminase from Arthrobacter sp
atggcgttctcaacggacacccctgaaatcgtttacacccacgacaccggtctggactatatcacctactctgactacgaactggacccggctaacccgctgtatggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 166 - protein, 330 aa, Artificial Sequence
  Variants of transaminase from Arthrobacter sp
MAFSTDTPEIVYTHDTGLDYITYSDYELDPANPLYGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 167 - DNA, 990 bp, Artificial Sequence
  Variants of transaminase from Arthrobacter sp
atggcgttctcagcggacacccctgaaatcgtttacacccacgacaccggtcgtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 168 - protein, 330 aa, Artificial Sequence
  Variants of transaminase from Arthrobacter sp
MAFSADTPEIVYTHDTGRDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 169 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcaatgctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 170 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAINADITPAELYDADEVLGCSTAGGVWPFVSVDGNSISDGVPGPVTQSIIRRYWELNVEPSSLLTPVQY

SEQ ID NO: 171 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgttgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 172 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELYDADEVLGCSTAGGVWPFVSVDGNSISDGVPGPVTQSIIRRYWELNVEPSSLLTPVQY

SEQ ID NO: 173 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagtgatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 174 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEVILADITPAELYDADEVLGCSTAGGVWPFVSVDGNSISDGVPGPVTQSIIRRYWELNVEPSSLLTPVQY

SEQ ID NO: 175 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttcttgtctgaccccggtacagtac

SEQ ID NO: 176 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSCLTPVQY

SEQ ID NO: 177 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggcttgtctgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 178 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPACLYDADEVLGCSTAGGVWPFVSVDGNSISDGVPGPVTQSIIRRYWELNVEPSSLLTPVQY

SEQ ID NO: 179 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaaactatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 180 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHETILADITPAELYDADEVLGCSTAGGVWPFVSVDGNSISDGVPGPVTQSIIRRYWELNVEPSSLLTPVQY

SEQ ID NO: 181 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggcttcgatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 182 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILASITPAELYDADEVLGCSTAGGVWPFVSVDGNSISDGVPGPVTQSIIRRYWELNVEPSSLLTPVQY

SEQ ID NO: 183 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatcactgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 184 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLITAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 185 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggtggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 186 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 187 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggaccttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 188 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDLDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 189 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaactcgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 190 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNSLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 191 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtatgaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 192 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRMTVLEIAESLGHEAILADITPAELYDADEVLGCSTAGGVWPFVSVDGNSISDGVPGPVTQSIIRRYWELNVEPSSLLTPVQY

SEQ ID NO: 193 - DNA, 990 bp, Artificial Sequence
  Variants of transaminase from Arthrobacter sp
atggcgttctcagcggacacccctgaaatcgtttacacccacgacaccggtctggactatatcacctactctgaccacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgaaggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 194 - protein, 330 aa, Artificial Sequence
  Variants of transaminase from Arthrobacter sp
MAFSADTPEIVYTHDTGLDYITYSDHELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELKDADEVLGCSTAGGVWPFVSVDGNSISDGVPGPVTQSIIRRYWELNVEPSSLLTPVQY

SEQ ID NO: 195 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttccgctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 196 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVPLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 197 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgacgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 198 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALTGITRKTVLEIAESLGHEAILADITPAELYDADEVLGCSTAGGVWPFVSVDGNSISDGVPGPVTQSIIRRYWELNVEPSSLLTPVQY

SEQ ID NO: 199 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttccttttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 200 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFLLPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 201 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcccgttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 202 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFPLPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 203 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctgcgggacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 204 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILRDITPAELYDADEVLGCSTAGGVWPFVSVDGNSISDGVPGPVTQSIIRRYWELNVEPSSLLTPVQY

SEQ ID NO: 205 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacaatctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcattactgggaactgaacgttgaaccttcttctctgctgaccccggtacagtac

SEQ ID NO: 206 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNNLAEGPGFNVVVIKDGVVRSPGRAALPGITRKTVLEIAESLGHEAILADITPAELYDADEVLGCSTAGGVWPFVSVDGNSISDGVPGPVTQSIIRHYWELNVEPSSLLTPVQY

SEQ ID NO: 207 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctgggtatcacccgtaaaaccgttctggaaatcgctgaatctctgggtcacgaagctatcctggctgacatcaccccggctgaactgtgcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 208 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELCDADEVLGCSTAGGVWPFVSVDGNSISDGVPGPVTQSIIRRYWELNVEPSSLLTPVQY

SEQ ID NO: 209 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgttggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 210 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELLDADEVLGCSTAGGVWPFVSVDGNSISDGVPGPVTQSIIRRYWELNVEPSSLLTPVQY

SEQ ID NO: 211 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtcatgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 212 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGHVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 213 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatcctggcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 214 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLILAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 215 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactggcggctgaacgttgaaccttcttctctgctgaccccggtacagtac

SEQ ID NO: 216 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWRLNVEPSSLLTPVQY

SEQ ID NO: 217 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtgttacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 218 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGVTRKTVLEIAESLGHEAILADITPAELYDADEVLGCSTAGGVWPFVSVDGNSISDGVPGPVTQSIIRRYWELNVEPSSLLTPVQY

SEQ ID NO: 219 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcaccatgaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 220 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITMKTVLEIAESLGHEAILADITPAELYDADEVLGCSTAGGVWPFVSVDGNSISDGVPGPVTQSIIRRYWELNVEPSSLLTPVQY

SEQ ID NO: 221 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgtttggccttcttctctgctgaccccggtacagtac

SEQ ID NO: 222 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVWPSSLLTPVQY

SEQ ID NO: 223 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacacggcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 224 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTRRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 225 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacgggccgaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 226 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGPNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 227 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctggagggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 228 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALEGITRKTVLEIAESLGHEAILADITPAELYDADEVLGCSTAGGVWPFVSVDGNSISDGVPGPVTQSIIRRYWELNVEPSSLLTPVQY

SEQ ID NO: 229 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcccggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 230 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAIPADITPAELYDADEVLGCSTAGGVWPFVSVDGNSISDGVPGPVTQSIIRRYWELNVEPSSLLTPVQY

SEQ ID NO: 231 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcaggttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 232 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFRLPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 233 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccctgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 234 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETPDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 235 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaactgatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 236 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHELILADITPAELYDADEVLGCSTAGGVWPFVSVDGNSISDGVPGPVTQSIIRRYWELNVEPSSLLTPVQY

SEQ ID NO: 237 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcgggttaaaaacttccagtggggtgacctgatccgtgcaattcgggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 238 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPRVKNFQWGDLIRAIRETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 239 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtactaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 240 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRTTVLEIAESLGHEAILADITPAELYDADEVLGCSTAGGVWPFVSVDGNSISDGVPGPVTQSIIRRYWELNVEPSSLLTPVQY

SEQ ID NO: 241 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcgggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 242 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPRVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 243 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcaccgttaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 244 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITVKTVLEIAESLGHEAILADITPAELYDADEVLGCSTAGGVWPFVSVDGNSISDGVPGPVTQSIIRRYWELNVEPSSLLTPVQY

SEQ ID NO: 245 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacatggttccgggtccggttacccagtctatcatccgtcgttactgggaactgaacgttgaaccttcttctctgctgaccccggtacagtac

SEQ ID NO: 246 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDMVPGPVTQSIIRRYWELNVEPSSLLTPVQY

SEQ ID NO: 247 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatccgtgctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 248 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAIRADITPAELYDADEVLGCSTAGGVWPFVSVDGNSISDGVPGPVTQSIIRRYWELNVEPSSLLTPVQY

SEQ ID NO: 249 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacgggtctaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 250 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGSNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 251 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaactgtcttctctgctgaccccggtacagtac

SEQ ID NO: 252 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVELSSLLTPVQY

SEQ ID NO: 253 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggttatgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 254 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGYELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 255 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacgaggttccgggtccggttacccagtctatcatccgtcgttactgggaactgaacgttgaaccttcttctctgctgaccccggtacagtac

SEQ ID NO: 256 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDEVPGPVTQSIIRRYWELNVEPSSLLTPVQY

SEQ ID NO: 257 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaagacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcggtgctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 258 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAIGADITPAELYDADEVLGCSTAGGVWPFVSVDGNSISDGVPGPVTQSIIRRYWELNVEPSSLLTPVQY

SEQ ID NO: 259 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtaaggtac

SEQ ID NO: 260 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVRY

SEQ ID NO: 261 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttacttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 262 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVTSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 263 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttcggccttcttctctgctgaccccggtacagtac

SEQ ID NO: 264 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVRPSSLLTPVQY

SEQ ID NO: 265 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 266 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELMDADEVLGCSTAGGVWPFVSVDGNSISDGVPGPVTQSIIRRYWELNVEPSSLLTPVQY

SEQ ID NO: 267 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatctgggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 268 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAIWADITPAELYDADEVLGCSTAGGVWPFVSVDGNSISDGVPGPVTQSIIRRYWELNVEPSSLLTPVQY

SEQ ID NO: 269 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgcttgttctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 270 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIACSLGHEAILADITPAELYDADEVLGCSTAGGVWPFVSVDGNSISDGVPGPVTQSIIRRYWELNVEPSSLLTPVQY

SEQ ID NO: 271 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacaggctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 272 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNRLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 273 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaaccgatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 274 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEPILADITPAELYDADEVLGCSTAGGVWPFVSVDGNSISDGVPGPVTQSIIRRYWELNVEPSSLLTPVQY

SEQ ID NO: 275 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtgcgacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 276 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGATRKTVLEIAESLGHEAILADITPAELYDADEVLGCSTAGGVWPFVSVDGNSISDGVPGPVTQSIIRRYWELNVEPSSLLTPVQY

SEQ ID NO: 277 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcgaggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 278 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAIEADITPAELYDADEVLGCSTAGGVWPFVSVDGNSISDGVPGPVTQSIIRRYWELNVEPSSLLTPVQY

SEQ ID NO: 279 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctggtatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 280 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILAGITPAELYDADEVLGCSTAGGVWPFVSVDGNSISDGVPGPVTQSIIRRYWELNVEPSSLLTPVQY

SEQ ID NO: 281 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcaagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 282 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFKLPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 283 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggggaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 284 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGGNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 285 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtcttacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 286 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGLTRKTVLEIAESLGHEAILADITPAELYDADEVLGCSTAGGVWPFVSVDGNSISDGVPGPVTQSIIRRYWELNVEPSSLLTPVQY

SEQ ID NO: 287 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcgctgctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 288 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAIAADITPAELYDADEVLGCSTAGGVWPFVSVDGNSISDGVPGPVTQSIIRRYWELNVEPSSLLTPVQY

SEQ ID NO: 289 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctgtgctgaccccggtacagtac

SEQ ID NO: 290 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSVLTPVQY

SEQ ID NO: 291 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttcttggctgaccccggtacagtac

SEQ ID NO: 292 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSWLTPVQY

SEQ ID NO: 293 - DNA, 990 bp, Artificial Sequence
  Variants of transaminase from Arthrobacter sp
atggcgttctcagcggacacccctactatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaaacgatcaatgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 294 - protein, 330 aa, Artificial Sequence
  Variants of transaminase from Arthrobacter sp
MAFSADTPTIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHETINADITPAELYDADEVLGCSTAGGVWPFVSVDGNSISDGVPGPVTQSIIRRYWELNVEPSSLLTPVQY

SEQ ID NO: 295 - DNA, 990 bp, Artificial Sequence
  Variants of transaminase from Arthrobacter sp
atggcgttctcagcggacacccctactatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctacaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtggtaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 296 - protein, 330 aa, Artificial Sequence
  Variants of transaminase from Arthrobacter sp
MAFSADTPTIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRGTVLEIAESLGHEAILADITPAELYDADEVLGCSTAGGVWPFVSVDGNSISDGVPGPVTQSIIRRYWELNVEPSSLLTPVQY

SEQ ID NO: 297 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcggttgatcccgccgctgacccaggacgaagttaaagagatcgctctggaactggttgctaaaaccgaactgcgtgaagcgatggttaccgttacgatcacccgtggttactcttctggaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctcggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 298 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSGPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELYDADEVLGCSTAGGVWPFVSVDGNSISDGVPGPVTQSIIRRYWELNVEPSSLLTPVQY

SEQ ID NO: 299 - DNA, 990 bp, Artificial Sequence
  Variants of transaminase from Arthrobacter sp
atggcgttctcagcggacacccctactatcgtttacacccacgacaccggtctggactatatcacccagtttgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 300 - protein, 330 aa, Artificial Sequence
  Variants of transaminase from Arthrobacter sp
MAFSADTPTIVYTHDTGLDYITQFDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 301 - DNA, 990 bp, Artificial Sequence
  Variants of transaminase from Arthrobacter sp
atggcgttctcagcggacacccctactatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgagccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 302 - protein, 330 aa, Artificial Sequence
  Variants of transaminase from Arthrobacter sp
MAFSADTPTIVYTHDTGLDYITYSDYELDPANPLAGGAAWIGGAFVPPSEARIPIFDQGFYTSDATYTTFHVWNGNAFRLGDHIERLFSNAESIRLIPPLSQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 303 - DNA, 990 bp, Artificial Sequence
  Variants of transaminase from Arthrobacter sp
atggcgttctcagcggacacccctactatcgtttacacccacgacaccggtctggactatatcacccagtttgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgagccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagtaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 304 - protein, 330 aa, Artificial Sequence
  Variants of transaminase from Arthrobacter sp
MAFSADTPTIVYTHDTGLDYITQFDYELDPANPLAGGAAWIGGAFVPPSEARIPIFDQGFYTSDATYTTFHVWNGNAFRLGDHIERLFSNAESIRLIPPLSQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEVILADITPAELYDADEVLGCSTAGGVWPFVSVDGNSISDGVPGPVTQSIIRRYWELNVEPSSLLTPVQY

SEQ ID NO: 305 - DNA, 990 bp, Artificial Sequence
  Variants of transaminase from Arthrobacter sp
atggcgttctcagcggacacccctactatcgtttacacccacgacaccggtctggactatatcacctactttgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaaacgatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 306 - protein, 330 aa, Artificial Sequence
  Variants of transaminase from Arthrobacter sp
MAFSADTPTIVYTHDTGLDYITYFDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHETILADITPAELYDADEVLGCSTAGGVWPFVSVDGNSISDGVPGPVTQSIIRRYWELNVEPSSLLTPVQY

SEQ ID NO: 307 - DNA, 990 bp, Artificial Sequence
  Variants of transaminase from Arthrobacter sp
atggcgttctcagcggacacccctactatcgtttacacccacgacaccggtctggactatatcacccagtctgactacgaactgatgccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 308 - protein, 330 aa, Artificial Sequence
  Variants of transaminase from Arthrobacter sp
MAFSADTPTIVYTHDTGLDYITQSDYELMPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 309 - DNA, 990 bp, Artificial Sequence
  Variants of transaminase from Arthrobacter sp
atggcgttctcagcggacacccctactatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgagccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctcggtatcacccgtaaaaccgttctggaaatcgctgaatctctgggtcacgaagctatcctggctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 310 - protein, 330 aa, Artificial Sequence
  Variants of transaminase from Arthrobacter sp
MAFSADTPTIVYTHDTGLDTITQSDYELDPANPLAGGAAWIGGAFVPPSEARIPIFDQGFYTSDATYTTFHVWNGNAFRLGDHIERLFSNAESIRLIPPLSQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELYDADEVLGCSTAGGVWPFVSVDGNSISDGVPGPVTQSIIRRYWELNVEPSSLLTPVQY

SEQ ID NO: 311 - DNA, 990 bp, Artificial Sequence
  Variants of transaminase from Arthrobacter sp
atggcgttctcagcggacacccctactatcgtttacacccacgacaccggtctggactatatcacccagtttgactacgaactgatgccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 312 - protein, 330 aa, Artificial Sequence
  Variants of transaminase from Arthrobacter sp
MAFSADTPTIVYTHDTGLDYITQFDYELMPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 313 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttcggtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 314 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFGLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 315 - DNA, 990 bp, Artificial Sequence
  Variants of transaminase from Arthrobacter sp
atggcgttctcagcggacacccctactatcgtttacacccacgacaccggtctggactatatcacctactttgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtatcacccgtggtaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 316 - protein, 330 aa, Artificial Sequence
  Variants of transaminase from Arthrobacter sp
MAFSADTPTIVYTHDTGLDYITYFDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRGTVLEIAESLGHEAILADITPAELYDADEVLGCSTAGGVWPFVSVDGNSISDGVPGPVTQSIIRRYWELNVEPSSLLTPVQY

SEQ ID NO: 317 - DNA, 990 bp, Artificial Sequence
  Variants of transaminase from Arthrobacter sp
atggcgttctcagcggacacccctactatcgtttacacccacgacaccggtctggactatatcacctactttgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctcgaatgcggaatctattcggttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 318 - protein, 330 aa, Artificial Sequence
  Variants of transaminase from Arthrobacter sp
MAFSADTPTIVYTHDTGLDYITYFDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 319 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtatcacccgtggtaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 320 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRGTVLEIAESLGHEAILADITPAELYDADEVLGCSTAGGVWPFVSVDGNSISDGVPGPVTQSIIRRYWELNVEPSSLLTPVQY

SEQ ID NO: 321 - DNA, 990 bp, Artificial Sequence
  Variants of transaminase from Arthrobacter sp
atggcgttctcagcggacacccctactatcgtttacacccacgacaccggtctggactatatcacccagtttgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctcggtatcacccgtaaaaccgttctggaaatcgctgaatctctgggtcacgaaacgatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 322 - protein, 330 aa, Artificial Sequence
  Variants of transaminase from Arthrobacter sp
MAFSADTPTIVYTHDTGLDYITQFDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGITRKTVLEIAESLGHETILADITPAELYDADEVLGCSTAGGVWPFVSVDGNSISDGVPGPVTQSIIRRYWELNVEPSSLLTPVQY

SEQ ID NO: 323 - DNA, 990 bp, Artificial Sequence
  Variants of transaminase from Arthrobacter sp
atggcgttctcagcggacacccctactatcgtttacacccacgacaccggtctggacacaatcacctactttgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgagccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtggtaccgttctggaaatcgctgaatctctgggtcacgaagctatcctggctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 324 - protein, 330 aa, Artificial Sequence
  Variants of transaminase from Arthrobacter sp
MAFSADTPTIVYTHDTGLDTITYFDYELDPANPLAGGAAWIGGAFVPPSEARIPIFDQGFYTSDATYTTFHVWNGNAFRLGDHIERLFSNAESIRLIPPLSQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRGTVLEIAESLGHEAILADITPAELYDADEVLGCSTAGGVWPFVSVDGNSISDGVPGPVTQSIIRRYWELNVEPSSLLTPVQY

SEQ ID NO: 325 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctggaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtatcacccgtaaaaccgttctggaaatcgctgaatctctgggtcacgaagtaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 326 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSGPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEVILADITPAELYDADEVLGCSTAGGVWPFVSVDGNSISDGVPGPVTQSIIRRYWELNVEPSSLLTPVQY

SEQ ID NO: 327 - DNA, 990 bp, Artificial Sequence
  Variants of transaminase from Arthrobacter sp
atggcgttctcagcggacacccctgaaatcgtttacacccacgacaccggtctggacacaatcacccagtttgactacgaactggacccggctaacccgctggctggtggtgctgcttggattggaggtgctttcgttccgccgtcggaagctcgtatcccgttcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctggaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaaacgatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 328 - protein, 330 aa, Artificial Sequence
  Variants of transaminase from Arthrobacter sp
MAFSADTPEIVYTHDTGLDTITQFDYELDPANPLAGGAAWIGGAFVPPSEARIPFFDQGFYTSDATYTTFHVWNGNAFRLGDHIERLFSNAESIRLIPPLTQDEVKEIALELVAKTELREAMVTVTITRGYSSGPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHETILADITPAELYDADEVLGCSTAGGVWPFVSVDGNSISDGVPGPVTQSIIRRYWELNVEPSSLLTPVQY

SEQ ID NO: 329 - DNA, 990 bp, Artificial Sequence
  Variants of transaminase from Arthrobacter sp
atggcgttctcagcggacacccctactatcgtttacacccacgacaccggtctggacacaatcacccagtttgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 330 - protein, 330 aa, Artificial Sequence
  Variants of transaminase from Arthrobacter sp
MAFSADTPTIVYTHDTGLDTITQFDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 331 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 332 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 333 - DNA, 990 bp, Artificial Sequence
  Variants of transaminase from Arthrobacter sp
atggcgttctcagcggacacccctactatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttcggtctgggggaccacatcgaacgtctgttctctaatgcggaatctattcgtttgatcccgccgctgagccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 334 - protein, 330 aa, Artificial Sequence
  Variants of transaminase from Arthrobacter sp
MAFSADTPTIVYTHDTGLDYITYSDYELDPANPLAGGAAWIGGAFVPPSEARIPIFDQGFYTSDATYTTFHVWNGNAFGLGDHIERLFSNAESIRLIPPLSQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 335 - DNA, 990 bp, Artificial Sequence
  Variants of transaminase from Arthrobacter sp
atggcgttctcagcggacacccctactatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaaacgatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 336 - protein, 330 aa, Artificial Sequence
  Variants of transaminase from Arthrobacter sp
MAFSADTPTIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHETILADITPAELYDADEVLGCSTAGGVWPFVSVDGNSISDGVPGPVTQSIIRRYWELNVEPSSLLTPVQY

SEQ ID NO: 337 - DNA, 990 bp, Artificial Sequence
  Variants of transaminase from Arthrobacter sp
atggcgttctcagcggacacccctgaaatcgtttacacccacgacaccggtctggactatatcacctactcggactatgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggctgatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 338 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWLIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 339 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttgggccggtaacgctttccgtctgggggatcacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccatcttctttgctgaccccggtacagtac

SEQ ID NO: 340 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWAGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 341 - DNA, 990 bp, Artificial Sequence
  Variants of transaminase from Arthrobacter sp
atggcgttctcagcggacacccctgaaatcgtttacacccacgacaccggtctggactatatcacctactcggactatgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaagtatcttctttgctgaccccggtacagtac

SEQ ID NO: 342 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEVSSLLTPVQY

SEQ ID NO: 343 - DNA, 990 bp, Artificial Sequence
  Variants of transaminase from Arthrobacter sp
atggcgttctcagcggacacccctgaaatcgtttacacccacattaccggtctggactatatcacctacccggacccggaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcatgaatgcggaaatgattaggttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgttggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccatcttctttgctgaccccggtacagtac

SEQ ID NO: 344 - protein, 330 aa, Artificial Sequence
  Variants of transaminase from Arthrobacter sp
MAFSADTPEIVYTHITGLDYITYPDPELDPANPLAGGAAWIGGAFVPPSEARIPIFDQGFYTSDATYTTFHVWNGNAFRLGDHIERLFMNAEMIRLIPPLTQDEVKEIALELVAKTELREAMVTVTITRGYSSTPFERDITKHRPQVYMFASPYWQIVPLDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 345 - DNA, 990 bp, Artificial Sequence
  Variants of transaminase from Arthrobacter sp
atggcgttctcagcggacacccctgaaatcgtttacacccacgacaccggtctggaccatatcacctactcggactatgaactggacccggctaacctgctggctggtggtgctgcttggatcggaggtgctttcgttccgccgtcggaagctcgtatcccgatcttcgaccagggtttttatacttctgacgctacctacaccaccttccacgtttggaatggtaacgctttccgtctgggggatcacatcgaacgtctgttctctaatgcggaatctattaggttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgttggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccagttacccagtctatcatccgtcgttactgggaactgaacgttgaaccatcttctttgctgaccccggtccagtac

SEQ ID NO: 346 - protein, 330 aa, Artificial Sequence
  Variants of transaminase from Arthrobacter sp
MAFSADTPEIVYTHDTGLDHITYSDYELDPANLLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPLDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 347 - DNA, 990 bp, Artificial Sequence
  Variants of transaminase from Arthrobacter sp
atggcgttctcagcggacacccctgaaatcgtttacacccacgataccggtctggactatatcacctactcggactatgaactggacccggctaacccgctggctggtggtgctgcttggatcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcatgaatgcggaaatgattaggttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggctgatcgtaccgttcgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccatcttcttgtctgaccccggtacagtac

SEQ ID NO: 348 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFMNAEMIRLIPPLTQDEVKEIALELVAKTELREAMVTVTITRGYSSTPFERDITKHRPQVYMFASPYWLIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSCLTPVQY

SEQ ID NO: 349 - DNA, 990 bp, Artificial Sequence
  Variants of transaminase from Arthrobacter sp
atggcgttctcagcggacacccctgaaatcgtttacacccacattatcggtcgggaccatatcacctactcggactatgaactggacccggctaacccgctggctggtggtgctgcttggatcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcatgaatgcggaaatgattaggttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgttggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccatcttctttgctgaccccggtacagtac

SEQ ID NO: 350 - protein, 330 aa, Artificial Sequence
  Variants of transaminase from Arthrobacter sp
MAFSADTPEIVYTHIIGRDHITYSDYELDPANPLAGGAAWIGGAFVPPSEARIPIFDQGFYTSDATYTTFHVWNGNAFRLGDHIERLFMNAEMIRLIPPLTQDEVKEIALELVAKTELREAMVTVTITRGYSSTPFERDITKHRPQVYMFASPYWQIVPLDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 351 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcatgaatgcggaaatgattaggttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatcagggcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaagtatcttcttgtctgaccccggtacagtac

SEQ ID NO: 352 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFMNAEMIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEVSSCLTPVQY

SEQ ID NO: 353 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggatcggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaaatgattaggttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccatcttcttgtctgaccccggtacagtac

SEQ ID NO: 354 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAEMIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSCLTPVQY

SEQ ID NO: 355 - DNA, 990 bp, Artificial Sequence
  Variants of transaminase from Arthrobacter sp
atggcgttctcagcggacacccctgaaatcgtttacacccacgataccggtctggaccatatcacctactcggactatgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatcagggcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccatcttcttgtctgaccccggtacagtac

SEQ ID NO: 356 - protein, 330 aa, Artificial Sequence
  Variants of transaminase from Arthrobacter sp
MAFSADTPEIVYTHDTGLDHITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSCLTPVQY

SEQ ID NO: 357 - DNA, 990 bp, Artificial Sequence
  Variants of transaminase from Arthrobacter sp
atggcgttctcagcggacacccctgaaatcgtttacacccacgacaccggtctggaccatatcacctacccggactatgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcatgaatgcggaatctattaggttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatcacggcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 358 - protein, 330 aa, Artificial Sequence
  Variants of transaminase from Arthrobacter sp
MAFSADTPEIVYTHDTGLDHITYPDYELDPANPLAGGAAWIGGAFVPPSEARIPIFDQGFYTSDATYTTFHVWNGNAFRLGDHIERLFMNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLITAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 359 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctggggtcacacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctggacggtattacccgtaaaaccgttctggaaatcgctgaatctctgggtcacgaagctatcctggctgacatcaccccggctgagctgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 360 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGSHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALDGITRKTVLEIAESLGHEAILADITPAELYDADEVLGCSTAGGVWPFVSVDGNSISDGVPGPVTQSIIRRYWELNVEPSSLLTPVQY

SEQ ID NO: 361 - DNA, 990 bp, Artificial Sequence
  Variants of transaminase from Arthrobacter sp
atggcgttctcagcggacacccctcacatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcagtaatgcggaatccattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtcttacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 362 - protein, 330 aa, Artificial Sequence
  Variants of transaminase from Arthrobacter sp
MAFSADTPHIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGLTRKTVLEIAESLGHEAILADITPAELYDADEVLGCSTAGGVWPFVSVDGNSISDGVPGPVTQSIIRRYWELNVEPSSLLTPVQY

SEQ ID NO: 363 - DNA, 990 bp, Artificial Sequence
  Variants of transaminase from Arthrobacter sp
atggcgttctcagcggacacccctcacatcgtttacacccacgacaccggtctggactatatcacctactctgactacgaactggacccggctaacccgctggcaggtggcgctgcttggattggaggtgcttttgttccgccgtcggaagctcgtatcccgatcttcgaccagggtttttatacttctgacgctacctacaccaccttccacgtttggaacggtaacgctttccgtctgggggaccacatcgaacgtctgttccagaatgcggaatccattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaagcatcgtcctcaagtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtattacccgtaaaaccgttctggaaatcgctgaatctctgggtcacgaagctatcctggctgacatcaccccggcttgcctgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 364 - protein, 330 aa, Artificial Sequence
  Variants of transaminase from Arthrobacter sp
MAFSADTPHIVYTHDTGLDYITYSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPACLYDADEVLGCSTAGGVWPFVSVDGNSISDGVPGPVTQSIIRRYWELNVEPSSLLTPVQY

SEQ ID NO: 365 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaagcatcgtcctgccgtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctggacggtattacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 366 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPAVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALDGITRKTVLEIAESLGHEAILADITPAELYDADEVLGCSTAGGVWPFVSVDGNSISDGVPGPVTQSIIRRYWELNVEPSSLLTPVQY

SEQ ID NO: 367 - DNA, 990 bp, Artificial Sequence
  Variants of transaminase from Arthrobacter sp
atggcgttctcagcggacacccctcacatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggatcacatcgaacgtctgttccagaatgcggaatccattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtcttacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 368 - protein, 330 aa, Artificial Sequence
  Variants of transaminase from Arthrobacter sp
MAFSADTPHIVYTHDTGLDYITYSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGLTRKTVLEIAESLGHEAILADITPAELYDADEVLGCSTAGGVWPFVSVDGNSISDGVPGPVTQSIIRRYWELNVEPSSLLTPVQY

SEQ ID NO: 369 - DNA, 990 bp, Artificial Sequence
  Variants of transaminase from Arthrobacter sp
atggcgttctcagcggacacccctcacatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctggggtcacacatcgaacgtctgttccagaatgcggaatccattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtattacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 370 - protein, 330 aa, Artificial Sequence
  Variants of transaminase from Arthrobacter sp
MAFSADTPHIVYTHDTGLDYITYSDYELDPANPLAGGAAWIGGAFVPPSEARIPIFDQGFYTSDATYTTFHVWNGNAFRLGSHIERLFQNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 371 - DNA, 990 bp, Artificial Sequence
  Variants of transaminase from Arthrobacter sp
atggcgttctcagcggacacccctcacatcgtttacacccacgacaccggtctggactatatcacctactctgactacgaactggacccggctaacccgctggctggtggcgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcagtaatgcggaatccattcgtttgatcccgccgctgacccaggacgaagttaaagagatcgctgtggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtattacccgtaaaaccgttctggaaatcgctgaatctctgggtcacgaagctatcctggctgacatcaccccggctgagctgtacgacgctgacgaagttctgggttgctcaaccgcaggtggtgtttggccgttcgtttctgttgacggtaactctatctctgacggttttccgggtccggttacccagtctatcatccgtcgttactgggaactgaacgttgaaccttcttctctgctgaccccggtacagtac

SEQ ID NO: 372 - protein, 330 aa, Artificial Sequence
  Variants of transaminase from Arthrobacter sp
MAFSADTPHIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIAVELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGFPGPVTQSIIRRYWELNVEPSSLLTPVQY

SEQ ID NO: 373 - DNA, 990 bp, Artificial Sequence
  Variants of transaminase from Arthrobacter sp
atggcgttctcagcggacacccctcacatcgtttacacccacgacaccggtctggactatatcacctactctgactacgaactggacccggctaacccgctggctggtggtgctgcttggattggaggtgctttagttccgccgtcggaagctcgtatcccgatcttcgaccagggtttttatacttctgacgctacctacaccaccttccacgtttggaacggtaacgctttccgtctgggggatcacatcgaacgtctgttccagaatgcggaacatattcgtttgatcccgccgctgacccaggacgaagttaaagagatcgctctggaactggttgctaaaaccgaactgagggaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtattacccgtaaaaccgttctggaaatcgctgaatctctgggtcacgaagctatcctggctgacatcaccccggctgagctgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 374 - protein, 330 aa, Artificial Sequence
  Variants of transaminase from Arthrobacter sp
MAFSADTPHIVYTHDTGLDYITYSDYELDPANPLAGGAAWIGGALVPPSEARIPIFDQGFYTSDATYTTFHVWNGNAFRLGDHIERLFQNAEHIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 375 - DNA, 990 bp, Artificial Sequence
  Variants of transaminase from Arthrobacter sp
atggcgttctcagcggacacccctgaaatcgtttacacccacgacaccggtctggactatatcacctactctgactacgaactgaagccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccagaatgcggaatccattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 376 - protein, 330 aa, Artificial Sequence
  Variants of transaminase from Arthrobacter sp
MAFSADTPEIVYTHDTGLDYITYSDYELKPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 377 - DNA, 990 bp, Artificial Sequence
  Variants of transaminase from Arthrobacter sp
atggcgttctcagcggacacccctcacatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaacatattcgtttgatcccgccgctgacccaggacgaagttaaagagatcgctctggaactggttgctaaaaccgaactgagggaagcgatggttaccgttacgatcacccgtggttactcttctaccccattcgagcgtgacatcaccatgcatcgtcctcaagtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtcttacccgtaaaaccgttctggaaatcgctgaatctctgggtcacgaagctatcctggctgacatcaccccggctgagctgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 378 - protein, 330 aa, Artificial Sequence
  Variants of transaminase from Arthrobacter sp
MAFSADTPHIVYTHDTGLDYITYSDYELDPANPLAGGAAWIGGAFVPPSEARIPIFDQGFYTSDATYTTFHVWNGNAFRLGDHIERLFSNAEHIRLIPPLTQDEVKEIALELVAKTELREAMVTVTITRGYSSTPFERDITMHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGLTRKTVLEIAESLGHEAILADITPAELYDADEVLGCSTAGGVWPFVSVDGNSISDGVPGPVTQSIIRRYWELNVEPSSLLTPVQY

SEQ ID NO: 379 - DNA, 990 bp, Artificial Sequence
  Variants of transaminase from Arthrobacter sp
atggcgttctcagcggacacccctgaaatcgtttacacccacgacaccatactggactatatcacgtattctaggtacgaactggacccggctaacccactggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccggttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccctcttctctgctgaccccggtacagtac

SEQ ID NO: 380 - protein, 330 aa, Artificial Sequence
  Variants of transaminase from Arthrobacter sp
MAFSADTPEIVYTHDTILDYITYSRYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPVDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 381 - DNA, 990 bp, Artificial Sequence
  Variants of transaminase from Arthrobacter sp
atggcgttctcagcggacacccctgaaatcgtttacacccacgacaccatactggactatatcacgtattctaggtacgaactggacccggctaacccactggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 382 - protein, 330 aa, Artificial Sequence
  Variants of transaminase from Arthrobacter sp
MAFSADTPEIVYTHDTILDYITYSRYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 383 - DNA, 990 bp, Artificial Sequence
  Variants of transaminase from Arthrobacter sp
atggcgttctcagcggacacccctgaaatcgtttacacccacgacaccggtctggactatatcacgcattctaggtacgaactggacccggctaacccgctggctggtggtgctgcttggattggaggtgctttcgttccgccgtcggaagctcgtatcccgctttttgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctttggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaatattcttctctgctgaccccggtacagtac

SEQ ID NO: 384 - protein, 330 aa, Artificial Sequence
  Variants of transaminase from Arthrobacter sp
MAFSADTPEIVYTHDTGLDYITHSRYELDPANPLAGGAAWIGGAFVPPSEARIPLFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEYSSLLTPVQY

SEQ ID NO: 385 - DNA, 990 bp, Artificial Sequence
  Variants of transaminase from Arthrobacter sp
atggcgttctcagcggacacccctgaaatcgtttacacccacgacaccggtctggactatatcacgtattctaggtacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 386 - protein, 330 aa, Artificial Sequence
  Variants of transaminase from Arthrobacter sp
MAFSADTPEIVYTHDTGLDYITYSRYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 387 - DNA, 990 bp, Artificial Sequence
  Variants of transaminase from Arthrobacter sp
atggcgttctcagcggacacccctgaaatcgtttacacccacgacaccggtctggactatatcacctactctgattacgaactggacccggctaacccactggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccctgcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaatattcttctctgctgaccccggtacagtac

SEQ ID NO: 388 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITLHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEYSSLLTPVQY

SEQ ID NO: 389 - DNA, 990 bp, Artificial Sequence
  Variants of transaminase from Arthrobacter sp
atggcgttctcagcggacacccctgaaatcgtttacacccacgacaccatactggactatatcacgtattctaggtacgaactggacccggctaacccgctggctggtggtgctgcttggtttggaggtgctttcgttccgccgtcggaagctcgtatcccgatctttgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctttggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccctcttctctgctgaccccggtacagtac

SEQ ID NO: 390 - protein, 330 aa, Artificial Sequence
  Variants of transaminase from Arthrobacter sp
MAFSADTPEIVYTHDTILDYITYSRYELDPANPLAGGAAWFGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 391 - DNA, 990 bp, Artificial Sequence
  Variants of transaminase from Arthrobacter sp
atggcgttctcagcggacacccctgaaatcgtttacacccacgacaccggtctggactatatcacgtattctgattacgaactggacccggctaacccactggctggtggtgctgcttggattaccggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaagcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 392 - protein, 330 aa, Artificial Sequence
  Variants of transaminase from Arthrobacter sp
MAFSADTPEIVYTHDTGLDYITYSDYELDPANPLAGGAAWITGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 393 - DNA, 990 bp, Artificial Sequence
  Variants of transaminase from Arthrobacter sp
atggcgttctcagcggacacccctgaaatcgtttacacccacgacaccggtctggactatatcacgtattctaggtacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgtagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 394 - protein, 330 aa, Artificial Sequence
  Variants of transaminase from Arthrobacter sp
MAFSADTPEIVYTHDTGLDYITYSRYELDPANPLAGGAAWIGGAFVPPSEARIPIFDQGFYTSDATYTTFHVWNGNAFRLGDHIERLFSNAESIRLIPPLTQDVVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 395 - DNA, 990 bp, Artificial Sequence
  Variants of transaminase from Arthrobacter sp
atggcgttctcagcggacacccctgaaatcgtttacacccacgacaccggtctggactatatcctgtattctgattacgaactggacccggctaacccactggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaagcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 396 - protein, 330 aa, Artificial Sequence
  Variants of transaminase from Arthrobacter sp
MAFSADTPEIVYTHDTGLDYILYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 397 - DNA, 990 bp, Artificial Sequence
  Variants of transaminase from Arthrobacter sp
atggcgttctcagcggacacccctgaaatcgtttacacccacgacaccggtctggactatatcctgtattctgattacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggcgaccacatcgaacgtctgttctctaatgcggaatctattcgtttgatcccgccgctgacccaggacgaagttaaagagatcgctttggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccggttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 398 - protein, 330 aa, Artificial Sequence
  Variants of transaminase from Arthrobacter sp
MAFSADTPEIVYTHDTGLDYILYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPVDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 399 - DNA, 990 bp, Artificial Sequence
  Variants of transaminase from Arthrobacter sp
atggcgttctcagcggacacccctgaaatcgtttacacccacgacaccggtctggactatatcacgtattctgattacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgaccctggacgaagttaaagagatcgctctggaactggttgctaaaaccgaactgcgtgaagcgatggttaccgttacgatcacccgtggttactcttctaccccattcgagcgtgacatcaccaagcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 400 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTLDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 401 - DNA, 990 bp, Artificial Sequence
  Variants of transaminase from Arthrobacter sp
atggcgttctcagcggacacccctgaaatcgtttacacccacgacaccggtctggactatatcacgcattctaggtacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgaccctggacgaagttaaagagatcgctctggaactggttgctaaaaccgaactgcgtgaagcgatggttaccgttacgatcacccgtggttactcttctaccccattcgagcgtgacatcaccctgcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccctcttctctgctgaccccggtacagtac

SEQ ID NO: 402 - protein, 330 aa, Artificial Sequence
  Variants of transaminase from Arthrobacter sp
MAFSADTPEIVYTHDTGLDYITHSRYELDPANPLAGGAAWIGGAFVPPSEARIPIFDQGFYTSDATYTTFHVWNGNAFRLGDHIERLFSNAESIRLIPPLTLDEVKEIALELVAKTELREAMVTVTITRGYSSTPFERDITLHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 403 - DNA, 990 bp, Artificial Sequence
  Variants of transaminase from Arthrobacter sp
atggcgttctcagcggacacccctgaaatcgtttacacccacgacaccggtctggactatatcacgtattctgattacgaactggacccggctaacccgctggctggtggtgctgcttggattggaggtgctttcgttccgccgtcggaagctcgtatcccgattcgggaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaagcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 404 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIRDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 405 - DNA, 990 bp, Artificial Sequence
  Variants of transaminase from Arthrobacter sp
atggcgttctcagcggacacccctgaaatcgtttacacccacgacaccggtctggactatatcacgcattctgattacgaactggacccggctaacccactggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgaccctggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccctcttctctgctgaccccggtacagtac

SEQ ID NO: 406 - protein, 330 aa, Artificial Sequence
  Variants of transaminase from Arthrobacter sp
MAFSADTPEIVYTHDTGLDYITHSDYELDPANPLAGGAAWIGGAFVPPSEARIPIFDQGFYTSDATYTTFHVWNGNAFRLGDHIERLFSNAESIRLIPPLTLDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 407 - DNA, 990 bp, Artificial Sequence
  Variants of transaminase from Arthrobacter sp
atggcgttctcagcggacacccctgaaatcgtttacacccacgacaccggtctggactatatcacgtattctaggtacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaatattcttctctgctgaccccggtacagtac

SEQ ID NO: 408 - protein, 330 aa, Artificial Sequence
  Variants of transaminase from Arthrobacter sp
MAFSADTPEIVYTHDTGLDYITYSRYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEYSSLLTPVQY

SEQ ID NO: 409 - DNA, 990 bp, Artificial Sequence
  Variants of transaminase from Arthrobacter sp
atggcgttctcagcggacacccctgaaatcgtttacacccacgacaccggtctggactatatcacgtattctaggtacgaactggacccggctaacccactggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaagcatcgtccgcaggtttacatgttcgctagcccgtactggcagatcgtaccggttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccctcttctctgctgaccccggtacagtac

SEQ ID NO: 410 - protein, 330 aa, Artificial Sequence
  Variants of transaminase from Arthrobacter sp
MAFSADTPEIVYTHDTGLDYITYSRYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPVDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 411 - DNA, 990 bp, Artificial Sequence
  Variants of transaminase from Arthrobacter sp
atggcgttctcagcggacacccctgaaatcgtttacacccacgacaccggtctggactatatcacgcattctgattacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaagcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaatattcttctctgctgaccccggtacagtac

SEQ ID NO: 412 - protein, 330 aa, Artificial Sequence
  Variants of transaminase from Arthrobacter sp
MAFSADTPEIVYTHDTGLDYITHSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEYSSLLTPVQY

SEQ ID NO: 413 - DNA, 990 bp, Artificial Sequence
  Variants of transaminase from Arthrobacter sp
atggcgttctcagcggacacccctgaaatcgtttacacccacgacaccggtctggactatatcacgtattctaggtacgaactggacccggctaacatgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaagcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccctcttctctgctgaccccggtacagtac

SEQ ID NO: 414 - protein, 330 aa, Artificial Sequence
  Variants of transaminase from Arthrobacter sp
MAFSADTPEIVYTHDTGLDYITYSRYELDPANMLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 415 - DNA, 990 bp, Artificial Sequence
  Variants of transaminase from Arthrobacter sp
atggcgttctcagcggacacccctgaaatcgtttacacccacgacaccggtctggactatatcacgtattctgattacgaactggacccggctaacccgctggctggtggtgctgcttggtttggaggtgctttcgttccgccgtcggaagctcgtatcccgatttttgaccagggtttttatacttctgacgctacctacaccaccttccacgtttggaacggtaacgctttccgtctgggggaccacatcgaacgtctgttctctaatgcggaatctattcgtttgatcccgccgctgaccctggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccctcttctctgctgaccccggtacagtac

SEQ ID NO: 416 - protein, 330 aa, Artificial Sequence
  Variants of transaminase from Arthrobacter sp
MAFSADTPEIVYTHDTGLDYITYSDYELDPANPLAGGAAWFGGAFVPPSEARIPIFDQGFYTSDATYTTFHVWNGNAFRLGDHIERLFSNAESIRLIPPLTLDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 417 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaagcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaatattcttctctgctgaccccggtacagtac

SEQ ID NO: 418 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEYSSLLTPVQY

SEQ ID NO: 419 - DNA, 990 bp, Artificial Sequence
  Variants of transaminase from Arthrobacter sp
atggcgttctcagcggacacccctgaaatcgtttacacccacgacaccggtctggactatatcctgtattctgattacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggcgaccacatcgaacgtctgttctctaatgcggaatctattcgtttgatcccgccgctgaccctggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccagttacccagtctatcatccgtcgttactgggaactgaacgttgaaccctcttctctgctgaccccggtacagtac

SEQ ID NO: 420 - protein, 330 aa, Artificial Sequence
  Variants of transaminase from Arthrobacter sp
MAFSADTPEIVYTHDTGLDYILYSDYELDPANPLAGGAAWIGGAFVPPSEARIPIFDQGFYTSDATYTTFHVWNGNAFRLGDHIERLFSNAESIRLIPPLTLDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 421 - DNA, 990 bp, Artificial Sequence
  Variants of transaminase from Arthrobacter sp
atggcgttctcagcggacacccctgaaatcgtttacacccacgacaccatactggactatatcacgtattctgattacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggcgaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccggttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccctcttctctgctgaccccggtacagtac

SEQ ID NO: 422 - protein, 330 aa, Artificial Sequence
  Variants of transaminase from Arthrobacter sp
MAFSADTPEIVYTHDTILDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPVDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 423 - DNA, 990 bp, Artificial Sequence
  Variants of transaminase from Arthrobacter sp
atggcgttctcagcggacacccctgaaatcgtttacacccacgacaccggtggtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgacagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 424 - protein, 330 aa, Artificial Sequence
  Variants of transaminase from Arthrobacter sp
MAFSADTPEIVYTHDTGGDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELTDADEVLGCSTAGGVWPFVSVDGNSISDGVPGPVTQSIIRRYWELNVEPSSLLTPVQY

SEQ ID NO: 425 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcctctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctgggtattaccaggaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 426 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVPLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELYDADEVLGCSTAGGVWPFVSVDGNSISDGVPGPVTQSIIRRYWELNVEPSSLLTPVQY

SEQ ID NO: 427 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcctcttgccgctgctgctggacggggacaacctgctggctgaaggtccgggtttcaacgttgttgttatcaaagacggtgttgttcgttctccgggtcgtgctgctctgcctggtgtaaccaggaaaaccgttctggaaatcgctgaatctctgggtcacgaagctatcctggctgacatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 428 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFLLPLLLDGDNLLAEGPGFNVVVIKDGVVRSPGRAALPGVTRKTVLEIAESLGHEAILADITPAELYDADEVLGCSTAGGVWPFVSVDGNSISDGVPGPVTQSIIRRYWELNVEPSSLLTPVQY

SEQ ID NO: 429 - DNA, 990 bp, Artificial Sequence
  Variants of transaminase from Arthrobacter sp
atggcgttctcagcggacacccctgaaatcgtttacacccacgacaccggtggtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgctggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagtgatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 430 - protein, 330 aa, Artificial Sequence
  Variants of transaminase from Arthrobacter sp
MAFSADTPEIVYTHDTGGDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPLVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEVILADITPAELYDADEVLGCSTAGGVWPFVSVDGNSISDGVPGPVTQSIIRRYWELNVEPSSLLTPVQY

SEQ ID NO: 431 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtattaccatgaaaaccgttctggaaatcgctgaatctctgggtcacgaagcgatcctggctgacatcaccccggctgaactgtatgacgctgacgaagttctgggttgctcaaccggcggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 432 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITMKTVLEIAESLGHEAILADITPAELYDADEVLGCSTGGGVWPFVSVDGNSISDGVPGPVTQSIIRRYWELNVEPSSLLTPVQY

SEQ ID NO: 433 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatcgattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtgtaaccaggaaaaccgttctggaaatcgctgaatctctgggtcacgaagctatcctggctgacatcaccccggctgaactgtatgacgctgacgaagttctgggttgctcaaccgccggtggtgtttggccgttcgtttctgttgacggtaactctatctctgacggtgttccgggtccggttacccagtctatcatccgtcgttactgggaactgaacgttgaaccttcttctttgctgaccccggtacagtac

SEQ ID NO: 434 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGVTRKTVLEIAESLGHEAILADITPAELYDADEVLGCSTAGGVWPFVSVDGNSISDGVPGPVTQSIIRRYWELNVEPSSLLTPVQY

SEQ ID NO: 435 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgctatgattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtattaccatgaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 436 - protein, 330 aa, Artificial Sequence
  Variants of transaminase from Arthrobacter sp
MAFSADTPEIVYTHDTGLDYITYSDYELDPANPLAGGAAMIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITMKTVLEIAESLGHEAILADITPAELYDADEVLGCSTAGGVWPFVSVDGNSISDGVPGPVTQSIIRRYWELNVEPSSLLTPVQY

SEQ ID NO: 437 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgctggtttacatgttcgctagcccgtactggcagatcgtaccgtttgaccgcatccgggacggtgttcctctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctttgctgaccccggtacagtac

SEQ ID NO: 438 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPLVYMFASPYWQIVPFDRIRDGVPLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 439 - DNA, 990 bp, Artificial Sequence
  Variants of transaminase from Arthrobacter sp
atggcgttctcagcggacacccctgaaatcgtttacacccacgacaccggtggtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactggtcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 440 - protein, 330 aa, Artificial Sequence
  Variants of transaminase from Arthrobacter sp
MAFSADTPEIVYTHDTGGDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELVDADEVLGCSTAGGVWPFVSVDGNSISDGVPGPVTQSIIRRYWELNVEPSSLLTPVQY

SEQ ID NO: 441 - DNA, 990 bp, Artificial Sequence
  Variants of transaminase from Arthrobacter sp
atggcgttctcagcggacacccctgaaatcgtttacacccacgacaccggtggtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtattaccatgaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctttgctgaccccggtacagtac

SEQ ID NO: 442 - protein, 330 aa, Artificial Sequence
  Variants of transaminase from Arthrobacter sp
MAFSADTPEIVYTHDTGGDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITMKTVLEIAESLGHEAILADITPAELYDADEVLGCSTAGGVWPFVSVDGNSISDGVPGPVTQSIIRRYWELNVEPSSLLTPVQY

SEQ ID NO: 443 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtgtaaccaggaaaaccgttctggaaatcgctgaatctctgggtcacgaagctatcctggctgacatcaccccggctgaactgtacgacgctgacgaagttctgggttgctcaaccggcggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 444 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGVTRKTVLEIAESLGHEAILADITPAELYDADEVLGCSTGGGVWPFVSVDGNSISDGVPGPVTQSIIRRYWELNVEPSSLLTPVQY

SEQ ID NO: 445 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatgacgctgacgaagttctgggttgctcaaccggcggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 446 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 447 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatcgattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcctctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagtgatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttcttggctgaccccggtacagtac

SEQ ID NO: 448 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVPLMVAQSVRRTPRSSIDPQVKNFQWGDLIRAIQETHDRGFELPLLLDGDNLLAEGPGFNVVVIKDGVVRSPGRAALPGITRKTVLEIAESLGHEVILADITPAELYDADEVLGCSTAGGVWPFVSVDGNSISDGVPGPVTQSIIRRYWELNVEPSSWLTPVQY

SEQ ID NO: 449 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactggtcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 450 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELVDADEVLGCSTAGGVWPFVSVDGNSISDGVPGPVTQSIIRRYWELNVEPSSLLTPVQY

SEQ ID NO: 451 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 452 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 453 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgactggtattaccaggaaaaccgttctggaaatcgctgaatctctgggtcacgaagtgatcctggctgacatcaccccggctgaactgacagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 454 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALTGITRKTVLEIAESLGHEVILADITPAELTDADEVLGCSTAGGVWPFVSVDGNSISDGVPGPVTQSIIRRYWELNVEPSSLLTPVQY

SEQ ID NO: 455 - DNA, 990 bp, Artificial Sequence
  Variants of transaminase from Arthrobacter sp
atggcgttctcagcggacacccctgaaatcgtttacacccacgacaccggtggtgactatatcacctactctgaccatgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcctggtgtaaccaggaaaaccgttctggaaatcgctgaatctctgggtcacgaagcgatcctggctgacatcaccccggctgaactgacagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 456 - protein, 330 aa, Artificial Sequence
  Variants of transaminase from Arthrobacter sp
MAFSADTPEIVYTHDTGGDYITYSDHELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGVTRKTVLEIAESLGHEAILADITPAELTDADEVLGCSTAGGVWPFVSVDGNSISDGVPGPVTQSIIRRYWELNVEPSSLLTPVQY

SEQ ID NO: 457 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgacagacgctgacgaagtcctgggttgctcaaccgccggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 458 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELTDADEVLGCSTAGGVWPFVSVDGNSISDGVPGPVTQSIIRRYWELNVEPSSLLTPVQY

SEQ ID NO: 459 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgacagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 460 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELTDADEVLGCSTAGGVWPFVSVDGNSISDGVPGPVTQSIIRRYWELNVEPSSLLTPVQY

SEQ ID NO: 461 - DNA, 990 bp, Artificial Sequence
  Variants of transaminase from Arthrobacter sp
atggcgttctcagcggacacccctgaaatcgtttacacccacgacaccggtggtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcctctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 462 - protein, 330 aa, Artificial Sequence
  Variants of transaminase from Arthrobacter sp
MAFSADTPEIVYTHDTGGDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVPLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 463 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagtgatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 464 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEVILADITPAELYDADEVLGCSTAGGVWPFVSVDGNSISDGVPGPVTQSIIRRYWELNVEPSSLLTPVQY

SEQ ID NO: 465 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtattaccatgaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 466 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITMKTVLEIAESLGHEAILADITPAELYDADEVLGCSTAGGVWPFVSVDGNSISDGVPGPVTQSIIRRYWELNVEPSSLLTPVQY

SEQ ID NO: 467 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatcgattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctgggtgtaaccaggaaaaccgttctggaaatcgctgaatctctgggtcacgaagcgatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 468 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGVTRKTVLEIAESLGHEAILADITPAELYDADEVLGCSTAGGVWPFVSVDGNSISDGVPGPVTQSIIRRYWELNVEPSSLLTPVQY

SEQ ID NO: 469 - DNA, 990 bp, Artificial Sequence
  Variants of transaminase from Arthrobacter sp
atggcgttctcagcggacacccctgaaatcgtttacacccacgacaccggtggtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctcgaacgcggaatcgattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctgggtattaccaggaaaaccgttctggaaatcgctgaatctctgggtcacgaagctatcctggctgacatcaccccggctgaactggtcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 470 - protein, 330 aa, Artificial Sequence
  Variants of transaminase from Arthrobacter sp
MAFSADTPEIVYTHDTGGDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELVDADEVLGCSTAGGVWPFVSVDGNSISDGVPGPVTQSIIRRYWELNVEPSSLLTPVQY

SEQ ID NO: 471 - DNA, 990 bp, Artificial Sequence
  Variants of transaminase from Arthrobacter sp
atggcgttctcagcggacacccctgaaatcgtttacacccacgacaccggtggtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgctggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 472 - protein, 330 aa, Artificial Sequence
  Variants of transaminase from Arthrobacter sp
MAFSADTPEIVYTHDTGGDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPLVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 473 - DNA, 990 bp, Artificial Sequence
  Variants of transaminase from Arthrobacter sp
atggcgttctcagcggacacccctgaaatcgtttacacccacgacaccggtaaggactatatcacctactctgactatgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctgggtattaccaggaaaaccgttctggaaatcgctgaatctctgggtcacgaagctatcctggctgacatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 474 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELYDADEVLGCSTAGGVWPFVSVDGNSISDGVPGPVTQSIIRRYWELNVEPSSLLTPVQY

SEQ ID NO: 475 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctgggtattaccaggaaaaccgttctggaaatcgctgaatctctgggtcacgaagctatcctggctgacatcaccccggctgaactggtcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctttgctgaccccggtacagtac

SEQ ID NO: 476 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELVDADEVLGCSTAGGVWPFVSVDGNSISDGVPGPVTQSIIRRYWELNVEPSSLLTPVQY

SEQ ID NO: 477 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgctggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 478 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPLVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 479 - DNA, 990 bp, Artificial Sequence
  Variants of transaminase from Arthrobacter sp
atggcgttctcagcggacacccctgaaatcgtttacacccacgacaccggtggtgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtattaccaggaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 480 - protein, 330 aa, Artificial Sequence
  Variants of transaminase from Arthrobacter sp
MAFSADTPEIVYTHDTGGDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 481 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgctggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctgggtattaccaggaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctttgctgaccccggtacagtac

SEQ ID NO: 482 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPLVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELYDADEVLGCSTAGGVWPFVSVDGNSISDGVPGPVTQSIIRRYWELNVEPSSLLTPVQY

SEQ ID NO: 483 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgctggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtattaccaggaaaaccgttctggaaatcgctgaatctctgggtcacgaagcgatcctggctgacatcaccccggctgaactggtcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctttgctgaccccggtacagtac

SEQ ID NO: 484 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPLVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELVDADEVLGCSTAGGVWPFVSVDGNSISDGVPGPVTQSIIRRYWELNVEPSSLLTPVQY

SEQ ID NO: 485 - DNA, 990 bp, Artificial Sequence
  Variants of transaminase from Arthrobacter sp
atggcgttctcagcggacacccctgaaatcgtttacacccacgacaccggtaaggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcctctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagcgatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 486 - protein, 330 aa, Artificial Sequence
  Variants of transaminase from Arthrobacter sp
MAFSADTPEIVYTHDTGKDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVPLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 487 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgctatgattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcctctgatggttgctcagtcagttcgtcgtacaccgcgtagctctatcgacccgcaggttaaaaacttccagtggggtgacctgatccgtgcaattcaggaaacccacgatcgtggtttcctcttgccgctgctgctggacggggacaacctgctggctgaaggtccgggtttcaacgttgttgttatcaaagacggtgttgttcgttctccgggtcgtgctgctctgggaggtattaccaggaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 488 - protein, 330 aa, Artificial Sequence
  Variants of transaminase from Arthrobacter sp
MAFSADTPEIVYTHDTGLDYITYSDYELDPANPLAGGAAMIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVPLMVAQSVRRTPRSSIDPQVKNFQWGDLIRAIQETHDRGFLLPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 489 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacgggccgaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactggtcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 490 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGPNLLAEGPGFNVVVIKDGVVRSPGRAALPGITRKTVLEIAESLGHEAILADITPAELVDADEVLGCSTAGGVWPFVSVDGNSISDGVPGPVTQSIIRRYWELNVEPSSLLTPVQY

SEQ ID NO: 491 - DNA, 990 bp, Artificial Sequence
  Variants of transaminase from Arthrobacter sp
atggcgttctcagcggacacccctgaaatcgtttacacccacgacaccggtcttgactatatcacctactctgactatgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcatctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcctggtgtaaccatgaaaaccgttctggaaatcgctgaatctctgggtcacgaagctatcctggctgacatcaccccggctgaactggtcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 492 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGVTMKTVLEIAESLGHEAILADITPAELVDADEVLGCSTAGGVWPFVSVDGNSISDGVPGPVTQSIIRRYWELNVEPSSLLTPVQY

SEQ ID NO: 493 - DNA, 990 bp, Artificial Sequence
  Variants of transaminase from Arthrobacter sp
atggcgttctcagcggacacccctgaaatcgtttacacccacgacaccggtcttgactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcctctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgctgggtattaccaggaaaaccgttctggaaatcgctgaatctctgggtcacgaagctatcctggctgacatcaccccggctgaactgacagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 494 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVPLMVAQSVRRTPRSSIDPQVKNFQWGDLIRAIQETHDRGFELPLLLDGDNLLAEGPGFNVVVIKDGVVRSPGRAALLGITRKTVLEIAESLGHEAILADITPAELTDADEVLGCSTAGGVWPFVSVDGNSISDGVPGPVTQSIIRRYWELNVEPSSLLTPVQY

SEQ ID NO: 495 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctgggcggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacctagataaccggctggctgaaggtccgggtttcaacgttgttgttatcaaagacggtgttgttcgttctccgggtcgtgctgctctgcccggtatcacccgaacgaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 496 - protein, 330 aa, Artificial Sequence
  Variants of transaminase from Arthrobacter sp
MAFSADTPEIVYTHDTGLDYITYSDYELDPANPLGGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDLDNRLAEGPGFNVVVIKDGVVRSPGRAALPGITRTTVLEIAESLGHEAILADITPAELYDADEVLGCSTAGGVWPFVSVDGNSISDGVPGPVTQSIIRRYWELNVEPSSLLTPVQY

SEQ ID NO: 497 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtatgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacctaggtaaccggctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 498 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPYDRIRDGVHLMVAQSVRRTPRSSIDPQVKNFQWGDLIRAIQETHDRGFELPLLLDLGNRLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 499 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatccccccgctgttacaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtatgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgaattgccgctgctgctggacggggacaacctgctggctgaaggtccgggtttcaacgttgttgttatcaaagacggtgttgttcgttctccgggtcgtgctgctctggaaggtatcacccgaatgaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 500 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLLQDEVKEIALELVAKTELREAMVTVTITRGYSSTPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALEGITRMTVLEIAESLGHEAILADITPAELYDADEVLGCSTAGGVWPFVSVDGNSISDGVPGPVTQSIIRRYWELNVEPSSLLTPVQY

SEQ ID NO: 501 - DNA, 990 bp, Artificial Sequence
  Variants of transaminase from Arthrobacter sp
atggcgttctcagcggacacccctgaaatcgtttacacccacaccaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggtgataaccggctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgaaggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 502 - protein, 330 aa, Artificial Sequence
  Variants of transaminase from Arthrobacter sp
MAFSADTPEIVYTHTTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNRLAEGPGFNVVVIKDGVVRSPGRAALPGITRKTVLEIAESLGHEAILADITPAELKDADEVLGCSTAGGVWPFVSVDGNSISDGVPGPVTQSIIRRYWELNVEPSSLLTPVQY

SEQ ID NO: 503 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggccggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgcgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgaattgccgctgctgctggacggggacaaccggctggctgaaggtccgggtttcaacgttgttgttatcaaagacggtgttgttcgttctccgggtcgtgctgctctgcccggtatcacccgaatgaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 504 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNRLAEGPGFNVVVIKDGVVRSPGRAALPGITRMTVLEIAESLGHEAILADITPAELYDADEVLGCSTAGGVWPFVSVDGNSISDGVPGPVTQSIIRRYWELNVEPSSLLTPVQY

SEQ ID NO: 505 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgccaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacctaggtaacctgctggctgaaggtccgggtttcaacgttgttgttatcaaagacggtgttgttcgttctccgggtcgtgctgctctgcccggtatcacccgaatgaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 506 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDLGNLLAEGPGFNVVVIKDGVVRSPGRAALPGITRMTVLEIAESLGHEAILADITPAELYDADEVLGCSTAGGVWPFVSVDGNSISDGVPGPVTQSIIRRYWELNVEPSSLLTPVQY

SEQ ID NO: 507 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgccaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtatcacccgaatgaccgttctggaaatcgctgaatctctgggtcacgaagctatcctggctgacatcaccccggctgaactgaaggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 508 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRMTVLEIAESLGHEAILADITPAELKDADEVLGCSTAGGVWPFVSVDGNSISDGVPGPVTQSIIRRYWELNVEPSSLLTPVQY

SEQ ID NO: 509 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctgggcggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatccccccgctgactcaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggtgataaccggctggctgaaggtccgggtttcaacgttgttgttatcaaagacggtgttgttcgttctccgggtcgtgctgctctgcccggtatcacccgaacgaccgttctggaaatcgctgaatctctgggtcacgaagctatcctggctgacatcaccccggctgaactgaaggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 510 - protein, 330 aa, Artificial Sequence
  Variants of transaminase from Arthrobacter sp
MAFSADTPEIVYTHDTGLDYITYSDYELDPANPLGGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNRLAEGPGFNVVVIKDGVVRSPGRAALPGITRTTVLEIAESLGHEAILADITPAELKDADEVLGCSTAGGVWPFVSVDGNSISDGVPGPVTQSIIRRYWELNVEPSSLLTPVQY

SEQ ID NO: 511 - DNA, 990 bp, Artificial Sequence
  Variants of transaminase from Arthrobacter sp
atggcgttctcagcggacacccctgaaatcgtttacacccacaccaccggtctggactatatcacctactctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtatcacccgaatgaccgttctggaaatcgctgaatctctgggtcacgaagctatcctagcggatatcaccccggctgaactgaaggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 512 - protein, 330 aa, Artificial Sequence
  Variants of transaminase from Arthrobacter sp
MAFSADTPEIVYTHTTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRMTVLEIAESLGHEAILADITPAELKDADEVLGCSTAGGVWPFVSVDGNSISDGVPGPVTQSIIRRYWELNVEPSSLLTPVQY

SEQ ID NO: 513 - DNA, 990 bp, Artificial Sequence
  Variants of transaminase from Arthrobacter sp
atggcgttctcagcggacacccctgaaatcgtttacacccacaccaccggtctggactatatcacctactctgactacgaactggacccggctaacccgctgggcggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgaaggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 514 - protein, 330 aa, Artificial Sequence
  Variants of transaminase from Arthrobacter sp
MAFSADTPEIVYTHTTGLDYITYSDYELDPANPLGGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELKDADEVLGCSTAGGVWPFVSVDGNSISDGVPGPVTQSIIRRYWELNVEPSSLLTPVQY

SEQ ID NO: 515 - DNA, 990 bp, Artificial Sequence
  Variants of transaminase from Arthrobacter sp
atggcgttctcagcggacacccctgaaatcgtttacacccacgacaccggtctggactatatcacctactctgactacgaactggacccggctaacccgctggccggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatccccccgctgactcaggacgaagttaaagagatcgctctggaactggttgctaaaaccgaactgcgtgaagcgatggttaccgttacgatcacccgtggttactcttctaccccattcgagcgtgacatcaccaaacatcgtccgcaggtttacatgttcgctagcccgtactggcagatcgtaccgtatgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgcccggtatcacccgaaagaccgttctggaaatcgctgaatctctgggtcacgaagctatcctggctgacatcaccccggctgaactgaaggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 516 - protein, 330 aa, Artificial Sequence
  Variants of transaminase from Arthrobacter sp
MAFSADTPEIVYTHDTGLDYITYSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSTPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALPGITRKTVLEIAESLGHEAILADITPAELKDADEVLGCSTAGGVWPFVSVDGNSISDGVPGPVTQSIIRRYWELNVEPSSLLTPVQY

SEQ ID NO: 517 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 518 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 519 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcatgaatgcggaaatgattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccggttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggtggtatcacccgtatgaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 520 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFMNAEMIRLIPPLTQDEVKEIALELVAKTELREAMVTVTITRGYSSSPFERDITKHRPQVYMFASPYWQIVPVDRIRDGVHLMVAQSVRRTPRSSIDPQVKNFQWGDLIRAIQETHDRGFELPLLLDGDNLLAEGPGFNVVVIKDGVVRSPGRAALGGITRMTVLEIAESLGHEAILADITPAELYDADEVLGCSTAGGVWPFVSVDGNSISDGVPGPVTQSIIRRYWELNVEPSSLLTPVQY

SEQ ID NO: 521 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcatgaatgcggaaatgattcgtttgatcccgccgctgagccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggtggtatcacccgtaagaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 522 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFMNAEMIRLIPPLSQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 523 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctgatgggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgcagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 524 - protein, 330 aa, Artificial Sequence
  Variants of transaminase from Arthrobacter sp
MAFSADTPEIVYTHDTGLDTITQSDYELDPANPLMGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 525 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaatggaacgttgaaccttcttctctgctgaccccggtacagtac

SEQ ID NO: 526 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWEWNVEPSSLLTPVQY

SEQ ID NO: 527 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcgctaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 528 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDIAKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 529 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaatcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 530 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITNHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 531 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatgaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 532 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDMTKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 533 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaagcttcttctctgctgaccccggtacagtac

SEQ ID NO: 534 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEASSLLTPVQY

SEQ ID NO: 535 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaacgtatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 536 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKRIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 537 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctcgtctgctgaccccggtacagtac

SEQ ID NO: 538 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSRLLTPVQY

SEQ ID NO: 539 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaacacgatctctgacggtgttccgggtccggttacccagtctatcatccgtcgttactgggaactgaacgttgaaccttcttctctgctgaccccggtacagtac

SEQ ID NO: 540 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNTISDGVPGPVTQSIIRRYWELNVEPSSLLTPVQY

SEQ ID NO: 541 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttaggctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 542 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVRLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 543 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtgtttctatctctgacggtgttccgggtccggttacccagtctatcatccgtcgttactgggaactgaacgttgaaccttcttctctgctgaccccggtacagtac

SEQ ID NO: 544 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGVSISDGVPGPVTQSIIRRYWELNVEPSSLLTPVQY

SEQ ID NO: 545 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgttacggttgacggtaactctatctctgacggtgttccgggtccggttacccagtctatcatccgtcgttactgggaactgaacgttgaaccttcttctctgctgaccccggtacagtac

SEQ ID NO: 546 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVTVDGNSISDGVPGPVTQSIIRRYWELNVEPSSLLTPVQY

SEQ ID NO: 547 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacagtaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 548 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDSTKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 549 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccagtgtacagtac

SEQ ID NO: 550 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTSVQY

SEQ ID NO: 551 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaatcttcttctctgctgaccccggtacagtac

SEQ ID NO: 552 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVESSSLLTPVQY

SEQ ID NO: 553 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtcagccgggtccggttacccagtctatcatccgtcgttactgggaactgaacgttgaaccttcttctctgctgaccccggtacagtac

SEQ ID NO: 554 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGQPGPVTQSIIRRYWELNVEPSSLLTPVQY

SEQ ID NO: 555 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccgtcggaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 556 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPSELYDADEVLGCSTAGGVWPFVSVDGNSISDGVPGPVTQSIIRRYWELNVEPSSLLTPVQY

SEQ ID NO: 557 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatgcgccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 558 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHAPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 559 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgacccaggtacagtac

SEQ ID NO: 560 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTQVQY

SEQ ID NO: 561 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatccataaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 562 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDIHKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 563 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtcttccgggtccggttacccagtctatcatccgtcgttactgggaactgaacgttgaaccttcttctctgctgaccccggtacagtac

SEQ ID NO: 564 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGLPGPVTQSIIRRYWELNVEPSSLLTPVQY

SEQ ID NO: 565 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgacccatgtacagtac

SEQ ID NO: 566 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTHVQY

SEQ ID NO: 567 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggacgatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 568 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWTIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 569 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctgtgctgctgaccccggtacagtac

SEQ ID NO: 570 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSVLLTPVQY

SEQ ID NO: 571 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaagggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 572 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWKGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 573 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggtgtatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 574 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWCIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 575 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggagacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctggacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 576 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 577 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaacgtcttctctgctgaccccggtacagtac

SEQ ID NO: 578 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVETSSLLTPVQY

SEQ ID NO: 579 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtaaggtac

SEQ ID NO: 580 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVRY

SEQ ID NO: 581 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctacgggtgttccgggtccggttacccagtctatcatccgtcgttactgggaactgaacgttgaaccttcttctctgctgaccccggtacagtac

SEQ ID NO: 582 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISTGVPGPVTQSIIRRYWELNVEPSSLLTPVQY

SEQ ID NO: 583 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacctgaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 584 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDLTKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 585 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaggggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 586 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWRGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 587 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcttgaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 588 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFLNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 589 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgatctgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 590 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTDLREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 591 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtggggagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 592 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGGELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 593 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtagtttac

SEQ ID NO: 594 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVVY

SEQ ID NO: 595 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttccgctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 596 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVPLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 597 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacggggctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 598 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYGADEVLGCSTAGGVWPFVSVDGNSISDGVPGPVTQSIIRRYWELNVEPSSLLTPVQY

SEQ ID NO: 599 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgcctgaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 600 - protein, 330 aa, Artificial Sequence
  Variants of transaminase from Arthrobacter sp
MAFSADTPEIVYTHDTGLDTITQSDYELDPANPLAGGAAWIGGAFVPPPEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 601 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaacttgatctctgacggtgttccgggtccggttacccagtctatcatccgtcgttactgggaactgaacgttgaaccttcttctctgctgaccccggtacagtac

SEQ ID NO: 602 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNLISDGVPGPVTQSIIRRYWELNVEPSSLLTPVQY

SEQ ID NO: 603 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctggaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 604 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFWNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 605 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtacggttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 606 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGTVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 607 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgcgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggttggtctatctctgacggtgttccgggtccggttacccagtctatcatccgtcgttactgggaactgaacgttgaaccttcttctctgctgaccccggtacagtac

SEQ ID NO: 608 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGWSISDGVPGPVTQSIIRRYWELNVEPSSLLTPVQY

SEQ ID NO: 609 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtattgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 610 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGIVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 611 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtacggttacccagtctatcatccgtcgttactgggaactgaacgttgaaccttcttctctgctgaccccggtacagtac

SEQ ID NO: 612 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGTVTQSIIRRYWELNVEPSSLLTPVQY

SEQ ID NO: 613 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagtgatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 614 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKVIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 615 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacaatctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 616 - protein, 330 aa, Artificial Sequence
  Variants of transaminase from Arthrobacter sp
MAFSADTPEIVYTHDTGLDTITQSDYELDPANNLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 617 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtcaggttacccagtctatcatccgtcgttactgggaactgaacgttgaaccttcttctctgctgaccccggtacagtac

SEQ ID NO: 618 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGQVTQSIIRRYWELNVEPSSLLTPVQY

SEQ ID NO: 619 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccagtcatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 620 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITSHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 621 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgctgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 622 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYAADEVLGCSTAGGVWPFVSVDGNSISDGVPGPVTQSIIRRYWELNVEPSSLLTPVQY

SEQ ID NO: 623 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacactgaaccttcttctctgctgaccccggtacagtac

SEQ ID NO: 624 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNTEPSSLLTPVQY

SEQ ID NO: 625 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttcgttaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 626 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFVNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 627 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaaatgatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 628 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKMIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 629 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtatgtctatctctgacggtgttccgggtccggttacccagtctatcatccgtcgttactgggaactgaacgttgaaccttcttctctgctgaccccggtacagtac

SEQ ID NO: 630 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGMSISDGVPGPVTQSIIRRYWELNVEPSSLLTPVQY

SEQ ID NO: 631 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccttgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 632 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETLDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 633 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtactttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 634 - protein, 330 aa, Artificial Sequence
  Variants of transaminase from Arthrobacter sp
MAFSADTPEIVYTHDTGLDTITQSDYELDPANPLAGGAAWIGGTFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 635 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccgagggaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 636 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPRELYDADEVLGCSTAGGVWPFVSVDGNSISDGVPGPVTQSIIRRYWELNVEPSSLLTPVQY

SEQ ID NO: 637 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagctggctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 638 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKELALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 639 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctgcatggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 640 - protein, 330 aa, Artificial Sequence
  Variants of transaminase from Arthrobacter sp
MAFSADTPEIVYTHDTGLDTITQSDYELDPANPLHGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 641 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtattccgggtccggttacccagtctatcatccgtcgttactgggaactgaacgttgaaccttcttctctgctgaccccggtacagtac

SEQ ID NO: 642 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGIPGPVTQSIIRRYWELNVEPSSLLTPVQY

SEQ ID NO: 643 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcctgccgccgtcggaagctcgtatcccgatcttcgaccagggtttttatacttctgacgctacctacaccaccttccacgtttggaacggtaacgctttccgtctgggggaccacatcgaacgtctgttccagaatgcggaatctattcgtttgatcccgccgctgacccaggacgaagttaaagagattgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccatacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 644 - protein, 330 aa, Artificial Sequence
  Variants of transaminase from Arthrobacter sp
MAFSADTPHIVYTHDTGLDTITQSDYELDPANPLAGGAAWIGGAFLPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 645 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccagaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccatacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 646 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 647 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtagactacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 648 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVDYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 649 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccaccgctgacccaggacgaagttaaagagattgctctgcaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtagactacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 650 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALQLVAKTELREAMVTVTITRGYSSSPFERDITKHRPQVYMFASPYWQIVDYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 651 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccagaatgcggaatctattcgtttgatcccgccgctgacccaggacgaagttaaagagattgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtagactacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 652 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVDYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 653 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccagaatgcggaatctattcgtttgatcccgccgctgacccaggacgaagttaaagagattgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccatacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 654 - protein, 330 aa, Artificial Sequence
  Variants of transaminase from Arthrobacter sp
MAFSADTPHIVYTHDTGLDTITQSDYELDPANPLHGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 655 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcattgcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 656 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 657 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagggggttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 658 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQGVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 659 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtccgtggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 660 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGPWPFVSVDGNSISDGVPGPVTQSIIRRYWELNVEPSSLLTPVQY

SEQ ID NO: 661 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 662 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 663 - DNA, 990 bp, Artificial Sequence
  Variants of transaminase from Arthrobacter sp
atggcgttctcagcggacacccctgaaatcgtttacacccacgacaccggtctggacactatcacctactctgactacgaactgtacccggctaacccgctggctggtggtgctgcttggattggaggtgctttcgttccgccgtcggaagctcgtatcccgaaattcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtccagtac

SEQ ID NO: 664 - protein, 330 aa, Artificial Sequence
  Variants of transaminase from Arthrobacter sp
MAFSADTPEIVYTHDTGLDTITYSDYELYPANPLAGGAAWIGGAFVPPSEARIPKFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 665 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaaccgggaaccttcttctctgctgaccccggtacagtac

SEQ ID NO: 666 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNREPSSLLTPVQY

SEQ ID NO: 667 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcagctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 668 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVQLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 669 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacgcggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 670 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDADNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 671 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacactgacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 672 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDTDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 673 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccgcaggaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 674 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPQELYDADEVLGCSTAGGVWPFVSVDGNSISDGVPGPVTQSIIRRYWELNVEPSSLLTPVQY

SEQ ID NO: 675 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctttgctgctgaccccggtacagtac

SEQ ID NO: 676 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSLLLTPVQY

SEQ ID NO: 677 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgtatgctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 678 - protein, 330 aa, Artificial Sequence
  Variants of transaminase from Arthrobacter sp
MAFSADTPEIVYTHDTGLDTITQSDYELDPANPYAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 679 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtgggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 680 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPWDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 681 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatgtgccgcaggtttacatgttcgctagcccgtactggcagatcgtaccgtttgaccgcatccgggacggtgttcacctgatggttgctcagtcagttcgtcgtacaccgcgtagctctatcgacccgcaggtcaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 682 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHVPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 683 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggttcgccgggtccggttacccagtctatcatccgtcgttactgggaactgaacgttgaaccttcttctctgctgaccccggtacagtac

SEQ ID NO: 684 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGSPGPVTQSIIRRYWELNVEPSSLLTPVQY

SEQ ID NO: 685 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggattctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 686 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNADSIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 687 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccggtggaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 688 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPVDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 689 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtaatttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 690 - protein, 330 aa, Artificial Sequence
  Variants of transaminase from Arthrobacter sp
MAFSADTPEIVYTHDTGLDTITQSDYELDPANPLAGGAAWIGGNFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 691 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaacccgtctgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 692 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTRLREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 693 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgggtctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 694 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAGSLGHEAILADITPAELYDADEVLGCSTAGGVWPFVSVDGNSISDGVPGPVTQSIIRRYWELNVEPSSLLTPVQY

SEQ ID NO: 695 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggttattctatctctgacggtgttccgggtccggttacccagtctatcatccgtcgttactgggaactgaacgttgaaccttcttctctgctgaccccggtacagtac

SEQ ID NO: 696 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGYSISDGVPGPVTQSIIRRYWELNVEPSSLLTPVQY

SEQ ID NO: 697 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccactgctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 698 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITTAELYDADEVLGCSTAGGVWPFVSVDGNSISDGVPGPVTQSIIRRYWELNVEPSSLLTPVQY

SEQ ID NO: 699 - DNA, 990 bp, Artificial Sequence
  Variants of transaminase from Arthrobacter sp
atggcgttctcagcggacacccctgaaatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtttgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactcggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 700 - protein, 330 aa, Artificial Sequence
  Variants of transaminase from Arthrobacter sp
MAFSADTPEIVYTHDTGLDTITQSDYELDPANPLAGGAAWIGGAFVPPSEARIPIFDQGFYTSDATYTTFHVWNGNAFRLGDHIERLFSNAESIRLIPPLTQDEVKEIALELVAKTELREAMVTVTITRGYSSSPFERDITKHRPQVYMFASPYWQIVPFDRIRDGVHLMVAQSVRRTPRSSIDPQVKNFQWGDLIRAIQETHDRGFELPLLLDSDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 701 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgttggctggtggtgctgcttggattggaggtgctttcgttccgccgtcggaagctcgtatcccgatcttcgaccagggtttttatacttctgacgctacctacaccaccttccacgtttggaaaggtaacgctttccgtctgggggaccacatcgaacgtctgttccaaaatgcggattctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcaaatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 702 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWKGNAFRLGDHIERLFQNADSIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 703 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccggtcgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggactctgacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacggtac

SEQ ID NO: 704 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPVDRIRDGVHLMVAQSVRRTPRSSIDPQVKNFQWGDLIRAIQETHDRGFELPLLLDSDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVRY

SEQ ID NO: 705 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgtatgctggtggtgctgcttggattggaggtgctttcgttccgccgtcggaagctcgtatcccgatcttcgaccagggtttttatacttctgacgctacctacaccaccttccacgtttggaaaggtaacgctttccgtctgggggaccacatcgaacgtctgttccaaaatgcggattctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgttagcgttgacggtaactctatctctgacggtgttccgggtccggttacccagtctatcatccgtcgttactgggaactgaacgttgaaccttcttctctgctgaccccggtacagtac

SEQ ID NO: 706 - protein, 330 aa, Artificial Sequence
  Variants of transaminase from Arthrobacter sp
MAFSADTPHIVYTHDTGLDTITQSDYELDPANPYAGGAAWIGGAFVPPSEARIPIFDQGFYTSDATYTTFHVWKGNAFRLGDHIERLFQNADSIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 707 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgttggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgttaccgttgacggtaactctatctctgacggtgtgccgggtccggttacccagtctatcatccgtcgttactgggaactgaacgttgaaccttcttctctgctgaccccggtacagtac

SEQ ID NO: 708 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVTVDGNSISDGVPGPVTQSIIRRYWELNVEPSSLLTPVQY

SEQ ID NO: 709 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctgcttggattggaggtgctttcgtgccgccgtcggaagctcgtatcccgatcttcgaccagggtttttatacttctgacgctacctacaccaccttccacgtttggaacggtaacgctttccgtctgggggaccacatcgaacgtctgttccagaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccatacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctcgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctcgcctgctgacccctgtacagtac

SEQ ID NO: 710 - protein, 330 aa, Artificial Sequence
  Variants of transaminase from Arthrobacter sp
MAFSADTPHIVYTHDTGLDTITQSDYELDPANPLHGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSRLLTPVQY

SEQ ID NO: 711 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 712 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 713 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggttatgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 714 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGYELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 715 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttgtgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 716 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVVITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 717 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgggttcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 718 - protein, 330 aa, Artificial Sequence
  Variants of transaminase from Arthrobacter sp
MAFSADTPHIVYTHDTGLDTITQSDYELDPANPLAGGAAWIGGAFVPGSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 719 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgaggctgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 720 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFEADITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 721 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtagtccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 722 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRSPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 723 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccggttttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 724 - protein, 330 aa, Artificial Sequence
  Variants of transaminase from Arthrobacter sp
MAFSADTPHIVYTHDTGLDTITQSDYELDPANPLAGGAAWIGGAFVPPSEARIPVFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 725 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 726 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 727 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttttgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctcctggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 728 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVLITRGYSSSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 729 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctacttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcaattcaggaaacccacgatcgtggtttcgagttgccgctgctgctggacggggacaacctgctggctgaaggtccgggtttcaacgttgttgttatcaaagacggtgttgttcgttctccgggtcgcgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 730 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSTSPFERDITKHRPQVYMFASPYWQIVPYDRIRDGVHLMVAQSVRRTPRSSIDPQVKNFQWGDLIRAIQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 731 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttatgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 732 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGYELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 733 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcctggattggaggtgctttcgttccgccgtcggaagctcgtatcccgattttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 734 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 735 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgtgccgccctcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 736 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 737 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 738 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 739 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttgtgatcacccgtggttactctacctcaccattcgagagggacatcaccaaacatcgtccgcaggtttacatgttcgctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 740 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVVITRGYSTSPFERDITKHRPQVYMFASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 741 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctagctcaccattcgaggctgacatcaccaaacatcgtccgcaggtttacatgtgggctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctagcctgctgaccccggtacagtac

SEQ ID NO: 742 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFEADITKHRPQVYMWASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 743 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctacctcaccattcgagagggacatcaccaaacatcgtccgcaggtttacatgttcgctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 744 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSTSPFERDITKHRPQVYMFASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 745 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggttatgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 746 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRSPRSSIDPQVKNFQWGDLIRALQETHDRGYELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 747 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctgcctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttttgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 748 - protein, 330 aa, Artificial Sequence
  Variants of transaminase from Arthrobacter sp
MAFSADTPHIVYTHDTGLDTITQSDYELDPANPLHGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 749 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcctggattggaggtgctttcgtgccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttatgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 750 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGYELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 751 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctagctcaccattcgagagggacatcaccaaacatcgtccgcaggtttacatgtgggctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctcgcctgctgaccccggtacagtac

SEQ ID NO: 752 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSRLLTPVQY

SEQ ID NO: 753 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgtgccgccctcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctagctcaccattcgagagggacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttttgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 754 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 755 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcctggattggaggtgctttcgtgccgccctcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtaccccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 756 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 757 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctgcctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactctagctcaccattcgaggctgacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 758 - protein, 330 aa, Artificial Sequence
  Variants of transaminase from Arthrobacter sp
MAFSADTPHIVYTHDTGLDTITQSDYELDPANPLHGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFEADITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 759 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcctggattggaggtgctttcgttccgccctcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttgtgatcacccgtggttactcttcttcaccattcgaggctgacatcaccaaacatcgtccgcaggtttacatgtttgctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 760 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVVITRGYSSSPFEADITKHRPQVYMFASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 761 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccggttttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttttgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 762 - protein, 330 aa, Artificial Sequence
  Variants of transaminase from Arthrobacter sp
MAFSADTPHIVYTHDTGLDTITQSDYELDPANPLAGGAAWIGGAFVPPSEARIPVFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 763 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttgtgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggttatgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 764 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVVITRGYSSSPFERDITKHRPQVYMFASPYWQIVPYDRIRDGVHLMVAQSVRRSPRSSIDPQVKNFQWGDLIRALQETHDRGYELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 765 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctgcctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 766 - protein, 330 aa, Artificial Sequence
  Variants of transaminase from Arthrobacter sp
MAFSADTPHIVYTHDTGLDTITQSDYELDPANPLHGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 767 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctgcctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctagctcaccattcgagagggacatcaccaaacatcgtccgcaggtttacatgttcgctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctagcctgctgaccccggtacagtac

SEQ ID NO: 768 - protein, 330 aa, Artificial Sequence
  Variants of transaminase from Arthrobacter sp
MAFSADTPHIVYTHDTGLDTITQSDYELDPANPLHGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 769 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 770 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 771 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctagcctgctgaccccggtacagtac

SEQ ID NO: 772 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 773 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctagcctgctgaccccggtacagtac

SEQ ID NO: 774 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 775 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggttatgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctagcctgctgaccccggtacagtac

SEQ ID NO: 776 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRSPRSSIDPQVKNFQWGDLIRALQETHDRGYELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 777 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccggttttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctagctcaccattcgagagggacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 778 - protein, 330 aa, Artificial Sequence
  Variants of transaminase from Arthrobacter sp
MAFSADTPHIVYTHDTGLDTITQSDYELDPANPLAGGAAWIGGAFVPPSEARIPVFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 779 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctggctggattggaggtgctttcgttccgccgtcggaagctcgtatcccggttttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactctagctcaccattcgaggctgacatcaccaaacatcgtccgcaggtttacatgtgggctagcccgtactggcagatcgtaccgtacgaccgcatccgggacggtgttcacctgatggttgctcagtcagttcgtcgtaccccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 780 - protein, 330 aa, Artificial Sequence
  Variants of transaminase from Arthrobacter sp
MAFSADTPHIVYTHDTGLDTITQSDYELDPANPLHGGAGWIGGAFVPPSEARIPVFDQGFYTSDATYTTFHVWNGNAFRLGDHIERLFQNAESIRLIPPLTQDEVKEIALELVAKTELREAMVTVTITRGYSSSPFEADITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 781 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgtgccgccctcggaagctcgtatcccgattttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttgtgatcacccgtggttactcttcttcaccattcgagcgtgacatcaccaaacatcgtccgcaggtttacatgtttgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 782 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVVITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 783 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttgtgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 784 - protein, 330 aa, Artificial Sequence
  Variants of transaminase from Arthrobacter sp
MAFSADTPHIVYTHDTGLDTITQSDYELDPANPLHGGAGWIGGAFVPPSEARIPIFDQGFYTSDATYTTFHVWNGNAFRLGDHIERLFQNAESIRLIPPLTQDEVKEIALELVAKTELREAMVTVVITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 785 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactctacctcaccattcgagagggacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttttgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctagcctgctgaccccggtacagtac

SEQ ID NO: 786 - protein, 330 aa, Artificial Sequence
  Variants of transaminase from Arthrobacter sp
MAFSADTPHIVYTHDTGLDTITQSDYELDPANPLHGGAGWIGGAFVPPSEARIPIFDQGFYTSDATYTTFHVWNGNAFRLGDHIERLFQNAESIRLIPPLTQDEVKEIALELVAKTELREAMVTVTITRGYSTSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 787 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctagctcaccattcgagagggacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctagcctgctgaccccggtacagtac

SEQ ID NO: 788 - protein, 330 aa, Artificial Sequence
  Variants of transaminase from Arthrobacter sp
MAFSADTPHIVYTHDTGLDTITQSDYELDPANPLHGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 789 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctagctcaccattcgagagggacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttatgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 790 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGYELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 791 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccggttttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagagggacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 792 - protein, 330 aa, Artificial Sequence
  Variants of transaminase from Arthrobacter sp
MAFSADTPHIVYTHDTGLDTITQSDYELDPANPLAGGAGWIGGAFVPPSEARIPVFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 793 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 794 - protein, 330 aa, Artificial Sequence
  Variants of transaminase from Arthrobacter sp
MAFSADTPHIVYTHDTGLDTITQSDYELDPANPLHGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 795 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgattttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactctacctcaccattcgagagggacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttttgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 796 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSTSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 797 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgtgccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctagcctgctgaccccggtacagtac

SEQ ID NO: 798 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 799 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctcgcctgctgaccccggtacagtac

SEQ ID NO: 800 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSRLLTPVQY

SEQ ID NO: 801 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctacctcaccattcgagagggacatcaccaaacatcgtccgcaggtttacatgtttgctagcccgtactggcagatcgtaccgtacgaccgcatccgggacggtgttcacctgatggttgctcagtcagttcgtcgtaccccgcgtagctctatcgacccgcaggttaaaaacttccagtggggtgacctgatccgtgcacttcaggaaacccacgatcgtggttttgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 802 - protein, 330 aa, Artificial Sequence
  Variants of transaminase from Arthrobacter sp
MAFSADTPHIVYTHDTGLDTITQSDYELDPANPLHGGAGWIGGAFVPPSEARIPIFDQGFYTSDATYTTFHVWNGNAFRLGDHIERLFQNAESIRLIPPLTQDEVKEIALELVAKTELREAMVTVTITRGYSTSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 803 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttgtgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttttgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 804 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVVITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 805 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctgcctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctacctcaccattcgagagggacatcaccaaacatcgtccgcaggtttacatgtttgctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 806 - protein, 330 aa, Artificial Sequence
  Variants of transaminase from Arthrobacter sp
MAFSADTPHIVYTHDTGLDTITQSDYELDPANPLHGGAAWIGGAFVPPSEARIPIFDQGFYTSDATYTTFHVWNGNAFRLGDHIERLFQNAESIRLIPPLTQDEVKEIALELVAKTELREAMVTVTITRGYSTSPFERDITKHRPQVYMFASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 807 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccggttttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactctagctcaccattcgagagggacatcaccaaacatcgtccgcaggtttacatgtgggctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttctagcctgctgaccccggtacagtac

SEQ ID NO: 808 - protein, 330 aa, Artificial Sequence
  Variants of transaminase from Arthrobacter sp
MAFSADTPHIVYTHDTGLDTITQSDYELDPANPLAGGAGWIGGAFVPPSEARIPVFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 809 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttactatcacccgtggttactcttcttcaccattcgagagggacatcaccaaacatcgtccgcaggtttacatgtgggctagcccgtactggcagatcgtaccgtacgaccgcatccgggacggtgttcacctgatggttgctcagtcagttcgtcgtagcccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 810 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRSPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 811 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctgcatggtggtgctggctggattggaggtgctttcgttccgccgtcggaagctcgtatcccggttttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgtgggctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtatgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 812 - protein, 330 aa, Artificial Sequence
  Variants of transaminase from Arthrobacter sp
MAFSADTPHIVYTHDTGLDTITQSDYELDPANPLHGGAGWIGGAFVPPSEARIPVFDQGFYTSDATYTTFHVWNGNAFRLGDHIERLFQNAESIRLIPPLTQDEVKEIALELVAKTELREAMVTVTITRGYSSSPFERDITKHRPQVYMWASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 813 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctggctggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactctacctcaccattcgagagggacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggttttgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgctagacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 814 - protein, 330 aa, Artificial Sequence
  Variants of transaminase from Arthrobacter sp
MAFSADTPHIVYTHDTGLDTITQSDYELDPANPLAGGAGWIGGAFVPPSEARIPIFDQGFYTSDATYTTFHVWNGNAFRLGDHIERLFQNAESIRLIPPLTQDEVKEIALELVAKTELREAMVTVTITRGYSTSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELLDADEVLGCSTAGGVWPFVSVDGNSISDGVPGPVTQSIIRRYWELNVEPSSLLTPVQY

SEQ ID NO: 815 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtcagttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 816 - protein, 330 aa, Artificial Sequence
  Variants of transaminase from Arthrobacter sp
MAFSADTPHIVYTHDTGLDTITQSDYELDPANPLAGGAAWIGGQFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 817 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccgttgctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 818 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITVAELYDADEVLGCSTAGGVWPFVSVDGNSISDGVPGPVTQSIIRRYWELNVEPSSLLTPVQY

SEQ ID NO: 819 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgaatcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 820 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPNRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 821 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgtggcaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 822 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLWQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 823 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttacgagtcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 824 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYESSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 825 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatcgcgcgttactgggaactgaacgttgaaccttcttctctgctgaccccggtacagtac

SEQ ID NO: 826 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIARYWELNVEPSSLLTPVQY

SEQ ID NO: 827 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgtttttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 828 - protein, 330 aa, Artificial Sequence
  Variants of transaminase from Arthrobacter sp
MAFSADTPHIVYTHDTGLDTITQSDYELDPANPLAGGAAWIGGAFVPPSEARIPFFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 829 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcagagctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 830 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAELADITPAELYDADEVLGCSTAGGVWPFVSVDGNSISDGVPGPVTQSIIRRYWELNVEPSSLLTPVQY

SEQ ID NO: 831 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtcttttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 832 - protein, 330 aa, Artificial Sequence
  Variants of transaminase from Arthrobacter sp
MAFSADTPHIVYTHDTGLDTITQSDYELDPANPLAGGAAWIGGLFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 833 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaacgagatctctgacggtgttccgggtccggttacccagtctatcatccgtcgttactgggaactgaacgttgaaccttcttctctgctgaccccggtacagtac

SEQ ID NO: 834 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNEISDGVPGPVTQSIIRRYWELNVEPSSLLTPVQY

SEQ ID NO: 835 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcagtaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 836 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDISKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 837 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttgatctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 838 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVDLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 839 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttacgattcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 840 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYDSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 841 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcaccgggcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 842 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHRAILADITPAELYDADEVLGCSTAGGVWPFVSVDGNSISDGVPGPVTQSIIRRYWELNVEPSSLLTPVQY

SEQ ID NO: 843 - DNA, 990 bp, Artificial Sequence
  Variants of transaminase from Arthrobacter sp
atggcgttctcagcggacacccctcatatcgtttacacccacgacaccggtcgtgacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 844 - protein, 330 aa, Artificial Sequence
  Variants of transaminase from Arthrobacter sp
MAFSADTPHIVYTHDTGRDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNSISDGVPGPVTQSIIRRYWELNVEPSSLLTPVQY

SEQ ID NO: 845 - DNA, 990 bp, Artificial Sequence
  Variants of transaminase from Arthrobacter sp
atggcgttctcagcggacacccctcatatcgtttacacccacgacaccggtctggacacaatcacccagtctgactacgaactggacccggctaacccgctggctggtggtgctgcttggattggaggtgctttcgttccgccgtcggaagctcgtatcccgatcttcgaccagggtttttatacttctgacgctacctacaccaccttccacgtttggaacggtaacgctttccgtctgggggaccacatcgaacgtctgttccaaaatgcggaatctattcgtttgatcccgccgctgacccaggacgaagttaaagagatcgctctggaactggttgctaaaaccgaactgcgtgaagcgatggttaccgttacgatcacccgtggttactcttcttcaccattcgagcgtgacatcaccaaacatcgtccgcaggtttacatgttcgctagcccgtactggcagatcgtaccgtacgaccgcatccgggacggtgttcacctgatggttgctcagtcagttcgtcgtacaccgcgtagctctatcgacccgcaggttaaaaacttccagtggggtgacctgatccgtgcacttcaggaaacccacgatcgtggtttcgagttgccgctgctgctggacggggacaacctgctggctgaaggtccgggtttcaacgttgttgttatcaaagacggtgttgttcgttctccgggtcgtgctgctctgggaggtatcacccgtaaaaccgttctggaaatcgctgaatctctgggtcacgaagcaatcctcgctgatatcaccccggctgaactgtacgacgctgacgaagttctgggttgctcaaccgcaggtggtgtttggccgttcgtttctgttgacggtaaccgtatctctgacggtgttccgggtccggttacccagtctatcatccgtcgttactgggaactgaacgttgaaccttcttctctgctgaccccggtacagtac

SEQ ID NO: 846 - protein, 330 aa, Artificial Sequence
  Variants of transaminase from Arthrobacter sp
MAFSADTPHIVYTHDTGLDTITQSDYELDPANPLAGGAAWIGGAFVPPSEARIPIFDQGFYTSDATYTTFHVWNGNAFRLGDHIERLFQNAESIRLIPPLTQDEVKEIALELVAKTELREAMVTVTITRGYSSSPFERDITKHRPQVYMFASPYWQIVPYDRIRDGVHLMVAQSVRRTPRSSIDPQVKNFQWGDLIRALQETHDRGFELPLLLDGDNLLAEGPGFNVVVIKDGVVRSPGRAALGGITRKTVLEIAESLGHEAILADITPAELYDADEVLGCSTAGGVWPFVSVDGNRISDGVPGPVTQSIIRRYWELNVEPSSLLTPVQY

What is claimed is:

1. An engineered polypeptide having transaminase activity comprising a polypeptide sequence having at least 90% sequence identity to SEQ ID NO: 2, wherein the polypeptide sequence of said engineered polypeptide comprises at least the substitutions L155W/P244G/T/L/E/D and wherein the amino acid positions of said polypeptide sequence are numbered with reference to SEQ ID NO: 2, and further wherein the engineered polypeptide has increased thermoactivity in a wet organic solvent relative to the engineered polypeptide of SEQ ID NO:6.

2. The engineered polypeptide of claim 1, wherein the polypeptide sequence of said engineered polypeptide comprises at least one substitution or substitution set at one or more positions in said polypeptide sequence selected from 20, 23, and 284, wherein the amino acid positions of said polypeptide sequence are numbered with reference to SEQ ID NO:2.

3. The engineered polypeptide of claim 1, wherein said polypeptide sequence has at least 90% sequence identity to SEQ ID NO:6, and wherein the polypeptide sequence of said engineered polypeptide comprises at least one substitution or substitution set at one or more positions in said polypeptide sequence selected from 5T/35Y, 9H/T, 9T/20T/23Q/24F/134S/244G, 9T/20T/23Q/101S/244L, 9T/20T/24F/101S/244G/249G, 9T/23Q/24F, 9T/23Q/24F/29M/244G, 9T/23Q/24F/101S/262V, 9T/23Q/24F/244L/262T, 9T/23Q/29M, 9T/24F/244G, 9T/24F/244G/262T, 9T/24F/249G, 9T/79G/101S/244G, 9T/101S/244G, 9T/244G/249G, 9T/244G/262T/264N, 9T/262T, 15I/T, 15I/16I/18R/20H/89M/93M/160L, 15I/24P/26P/89M/93M/160L, 15T/35G/273K, 15T/218R/273K, 15T/249M/273K, 16I, 17I/25R, 17I/25R/41F, 17I/25R/160V, 17I/160V, 18G/K/R, 18G/26H/246V/273T, 18G/146L, 18G/146L/262V, 18G/168P, 18G/244G, 18G/244G/248M, 18G/244L/273V, 18G/273T, 18G/273V, 18K/146L, 18K/146L/168P, 18K/168P, 18K/168P/244L, 18K/168P/262V/324W, 18K/244G/246V, 18K/244G/246V/284G, 18K/244L, 18K/244L/246V, 18K/244T/262V/273T, 18K/262V, 18K/273T, 20H/T, 20H/24P/89M/197T, 20H/33L/160L, 20H/324C, 20T/23Q/24F/55F/134G/244G/262T, 20T/23Q/134S/244G, 22H/L/W, 22L/102L, 22L/160V, 23H/Q, 23H/25R/55L/321Y, 23H/25R/102L/142L, 23H/102L, 23H/321Y, 24D/F/P, 25R, 25R/33M, 25R/104V, 25R/160V, 25R/321Y, 26H/273K, 26P, 29K/M, 29K/89Q, 32L/S, 33L/M/S, 35G, 35G/215L/218R/249T, 35G/218R/ 249T/273K, 35G/221D, 40M, 40M/168P/208L/244G, 40M/244G/248M, 41F/102L, 41K/Y, 42T, 45L, 46C, 50T, 55F/G/K/S, 56R, 71Y/102P, 74A, 79G, 79H, 82P, 82S/244D, 82T, 89L/M/Q/W, 89M/93M/156L/324C, 89M/93M/321V/324C, 90A/C/S/T, 93H/M/P, 93M/324C, 95P/T, 98M, 101L/S, 101L/160Y/244E/249M, 102L, 104I/S, 106S, 111L/T/, 114T, 117D, 119A, 134G, 134G/244L, 134G/262V, 134S, 139A, 140N/266N, 142L/321Y, 142T, 145N, 146A/H/I/L, 146A/244D, 146L/244L, 146L/273V, 156E/L/T, 160A/L/V/Y, 160Y/215L/216G/218R, 160Y/273K, 168P, 168P/244L/273T, 179R, 186R, 186R/200R, 197L, 197T, 203P, 207Y, 208K/L/P/R, 208L/246V, 215L, 215L/216G/249M, 216G/P/S, 216P/273V, 218N/313H, 218R/S, 218R/249M, 234H, 236T, 244E/G/L/T, 244G/248M, 244G/248M/284G, 244L/273C, 244L/273V, 246A/L/V, 246V/248M/273V, 248M/V, 249G/M/T, 249M/273K, 256C, 262L/P/T/V, 264A/E/G/N/P/R/W, 265R, 266G/S, 271C, 273L/M/T/V, 284G, 301E/M, 316R, 320R/W, 321L/V/Y, 324C/V/W, and 329R, wherein the amino acid positions of said polypeptide sequence are numbered with reference to SEQ ID NO:6.

4. The engineered polypeptide of claim 1, wherein said engineered polypeptide comprises a polypeptide sequence that has at least 90% sequence identity to SEQ ID NO: 332, 518, or 656.

5. The engineered polypeptide of claim 1, wherein said engineered polypeptide comprises a variant engineered polypeptide comprising the amino acid sequence of SEQ ID NO: 332, SEQ ID NO:518, or SEQ ID NO:656.

6. The engineered polypeptide of claim 1, wherein said engineered polypeptide comprises a polypeptide sequence selected from the group consisting of SEQ ID NO: 172, 186, 198, 208, 228, 294, 296, 298, 302, 306, 310, 312, 318, 322, 324, 328, 330, 332, 334, 360, 366, 426, 432, 434, 436, 442, 444, 454, 466, 468, 470, 474, 476, 480, 482, 488, 494, 244, 518, 520, 522, 524, 526, 528, 530, 532, 534, 536, 538, 540, 542, 544, 546, 548, 550, 552, 554, 556, 558, 560, 562, 564, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660,662, 664, 668, 670, 672, 674, 676, 678, 680, 682, 684, 686, 688, 690, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844 and 846.

7. A polynucleotide sequence encoding at least one engineered polypeptide of claim 1.

8. A process for preparing a compound of structural Formula (I):

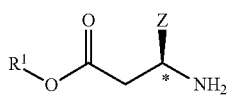
(I)

having the indicated stereochemical configuration at the stereogenic center marked with an *; in an enantiomeric excess of at least 70% over the opposite enantiomer, wherein Z is a linear C1-6 alkyl or a branched C1-6 alkyl, optionally substituted with one or more hydroxy, cyano, or nitro groups; and R1 is C1-6 alkyl, aryl-C1-2 alkyl, heteroaryl-C1-2 alkyl, or a 5- to 6-membered heterocyclic ring system optionally containing an additional heteroatom selected from O, S, and N, the heterocyclic ring being unsubstituted or substituted with one to three substituents independently selected from oxo, hydroxy, halogen, C1-4 alkoxy, and C1-4 alkyl; the process comprising the step of contacting a compound of structural Formula (II):

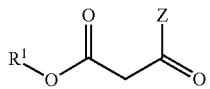
(II)

with an engineered polypeptide of claim 1 in the presence of an amino group donor under suitable reaction conditions.

9. The process of claim 8, wherein the compound of structural Formula (II)

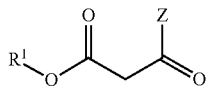
(II)

excludes compound (2)

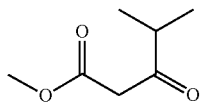
(2)

and the compound of structural Formula (I)

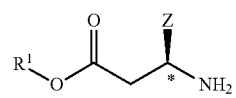
(I)

excludes compound (1)

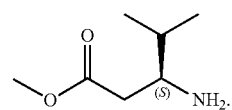
(1)

10. A process of preparing compound (1),

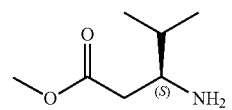
(1)

the process comprising a step of contacting a substrate of compound (2)

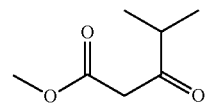
(2)

with an engineered polypeptide of claim 1, in the presence of an amino group donor under suitable reaction conditions.

11. The process of claim 8, wherein the compound of Formula (I) is produced in at least 90% enantiomeric excess.

12. The process of claim 8, wherein the compound of Formula (I) is produced in at least 99% enantiomeric excess.

13. The process of claim 8, wherein the amino group donor is selected from isopropylamine, alanine, 3-aminobutyric acid, or methylbenzylamine.

14. The process of claim 8, wherein the amino group donor is isopropylamine, optionally at a concentration of about 0.1 to about 3.0 M, 0.2 to about 2.5 M, about 0.5 to about 2 M, or about 1 to about 2 M.

15. The process of claim 8, wherein the suitable reaction conditions comprise a temperature of about 45° C. to about 60° C.

16. The process of claim 8, wherein the suitable reaction conditions comprise a wet organic solvent.

17. The process of claim 16, wherein the wet organic solvent is selected from wet isopropyl acetate, wet toluene, wet methyl tertiary-butyl ether, wet acetonitrile, or wet isopropyl alcohol.

18. The process of claim 17, wherein the wet organic solvent is isopropyl acetate.

19. The process of claim 10, wherein the suitable reaction conditions comprise the substrate compound at a loading of about 5 g/L to about 200 g/L, about 10 g/L to about 150 g/L, or about 50 g/L to about 100 g/L.

20. The process of claim 8, wherein the suitable reaction conditions comprise the engineered polypeptide at a concentration of from about 0.5 g/L to about 5 g/L, about 0.5 g/L to about 3 g/L, about 0.5 g/L to about 2 g/L, or from about 0.5 g/L to about 1 g/L.

21. The process of claim 10, wherein the suitable reaction conditions comprise: (a) substrate loading of about 10 to 220 g/L of substrate compound (2); (b) engineered polypeptide concentration of about 0.5 g/L to 25 g/L; (c) isopropylamine concentration of about 0.1 to 3 M; (d) a wet organic solvent; and (e) temperature of about 30° C. to 60° C.

22. The process of claim 10, wherein the suitable reaction conditions comprise: (a) about 20 g/L of substrate compound (2); (b) about 20 g/L engineered polypeptide; (c) wet isopropyl acetate; (d) about 0.55 M isopropylamine; and (e) about 50° C.

23. The process of claim 8, further comprising the step of isolating the compound of Formula (I) from the reaction.

24. The process of claim 10, wherein the compound (1) is produced in at least 90% enantiomeric excess.

25. The process of claim 10, wherein the compound (1) is produced in at least 99% enantiomeric excess.

26. The process of claim 10, further comprising the step of isolating the compound (1) from the reaction.

27. The engineered polypeptide of claim 1, wherein said engineered polypeptide comprises a polypeptide sequence that has at least 90% sequence identity to a polypeptide sequence selected from the group consisting of SEQ ID NO: 172, 186, 198, 208, 228, 294, 296, 298, 302, 306, 310, 312, 318, 322, 324, 328, 330, 332, 334, 360, 366, 426, 432, 434, 436, 442, 444, 454, 466, 468, 470, 474, 476, 480, 482, 488, 494, 244, 518, 520, 522, 524, 526, 528, 530, 532, 534, 536, 538, 540, 542, 544, 546, 548, 550, 552, 554, 556, 558, 560, 562, 564, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 668, 670, 672, 674, 676, 678, 680, 682, 684, 686, 688, 690, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844 and 846.

\* \* \* \* \*